(12) United States Patent
Hong et al.

(10) Patent No.: US 8,703,473 B2
(45) Date of Patent: *Apr. 22, 2014

(54) RECOMBINANT MICROBIAL HOST CELLS FOR HIGH EICOSAPENTAENOIC ACID PRODUCTION

(75) Inventors: Seung-Pyo Hong, Hockessin, DE (US); Pamela L. Sharpe, Wilmington, DE (US); Zhixiong Xue, Chadds Ford, PA (US); Narendra S. Yadav, Wilmington, DE (US); Hongxiang Zhang, Chadds Ford, PA (US); Quinn Qun Zhu, West Chester, PA (US)

(73) Assignee: E I du Pont de Nemours and Company, Wilmington, DE (US)

( * ) Notice: Subject to any disclaimer, the term of this patent is extended or adjusted under 35 U.S.C. 154(b) by 45 days.

This patent is subject to a terminal disclaimer.

(21) Appl. No.: 13/218,708

(22) Filed: Aug. 26, 2011

(65) Prior Publication Data

US 2012/0052537 A1    Mar. 1, 2012

Related U.S. Application Data

(60) Provisional application No. 61/377,248, filed on Aug. 26, 2010, provisional application No. 61/428,277, filed on Dec. 30, 2010, provisional application No. 61/479,921, filed on Apr. 28, 2011.

(51) Int. Cl.
*C12N 1/00* (2006.01)
*C12N 1/20* (2006.01)
*C12P 7/64* (2006.01)

(52) U.S. Cl.
USPC ............... 435/254.1; 435/252.3; 435/134

(58) Field of Classification Search
None
See application file for complete search history.

(56) References Cited

U.S. PATENT DOCUMENTS

| 7,238,482 | B2 | 7/2007 | Picataggio et al. |
| 7,901,928 | B2 | 3/2011 | Yadav et al. |
| 7,932,077 | B2 | 4/2011 | Damude et al. |
| 8,524,485 | B2 * | 9/2013 | Yadav et al. ............... 435/254.2 |
| 2006/0115881 | A1 * | 6/2006 | Damude et al. ............ 435/134 |
| 2008/0254191 | A1 | 10/2008 | Damude et al. |
| 2009/0093543 | A1 | 4/2009 | Xue et al. |
| 2009/0117253 | A1 | 5/2009 | Hong et al. |
| 2009/0325265 | A1 | 12/2009 | Damude et al. |
| 2010/0317072 | A1 * | 12/2010 | Hong et al. ................. 435/134 |
| 2010/0317735 | A1 | 12/2010 | Hong et al. |
| 2010/0317882 | A1 | 12/2010 | Yadav et al. |

OTHER PUBLICATIONS

International Search Report, PCT International Application No. PCT/US2011/049384, Mailed Dec. 9, 2011.
Related International Application, PCT Application No. PCT/US2011/049361, Mailed Dec. 9, 2012.
Related International Application, PCT Application No. PCT/US2011/049403, Mailed Dec. 9, 2012.
Related, U.S. Appl. No. 13/218,591 (Michael W. Bostick et al.) Filed Aug. 26, 2011.
Related, U.S. Appl. No. 13/218,673 (Melissa D. Bosak et al.) Filed Aug. 26, 2011.

* cited by examiner

*Primary Examiner* — Iqbal H Chowdhury

(57) ABSTRACT

Engineered strains of the oleaginous yeast *Yarrowia lipolytica* are disclosed herein that are capable of producing microbial oil comprising greater than 25 weight percent of eicosapentaenoic acid ["EPA"], an omega-3 polyunsaturated fatty acid, measured as a weight percent of dry cell weight.

7 Claims, 32 Drawing Sheets

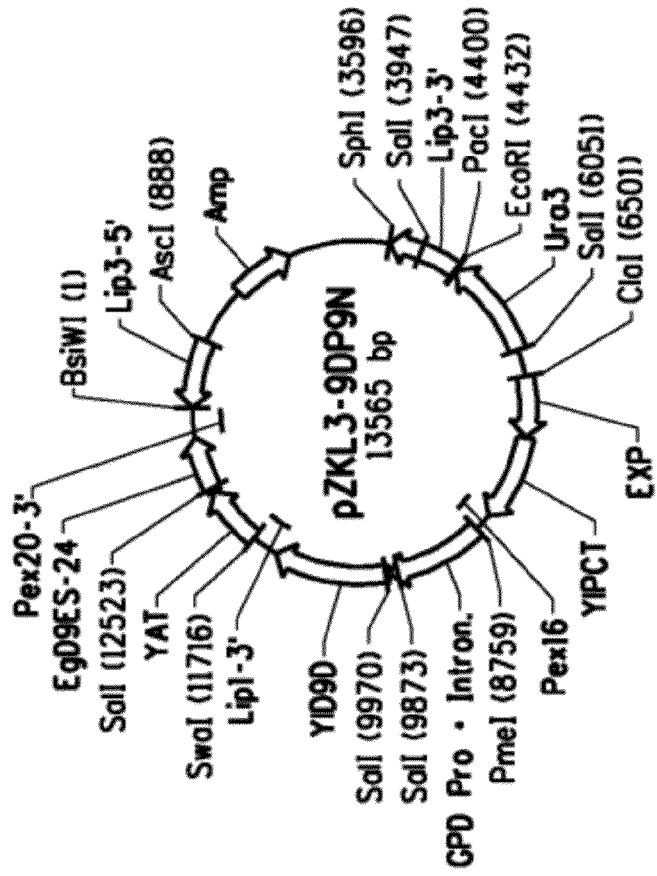
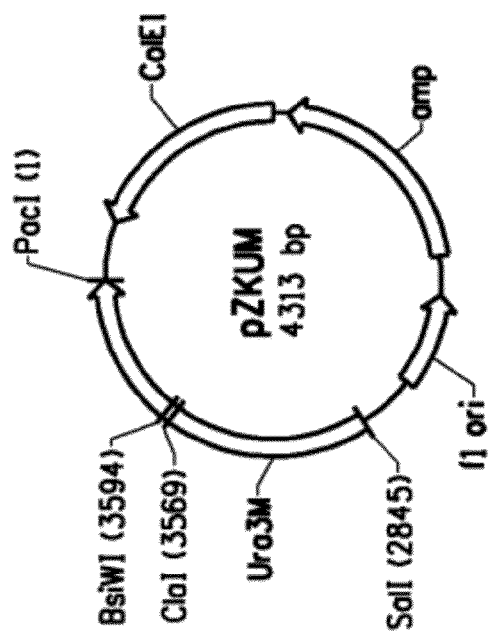
FIG. 4B
FIG. 4A

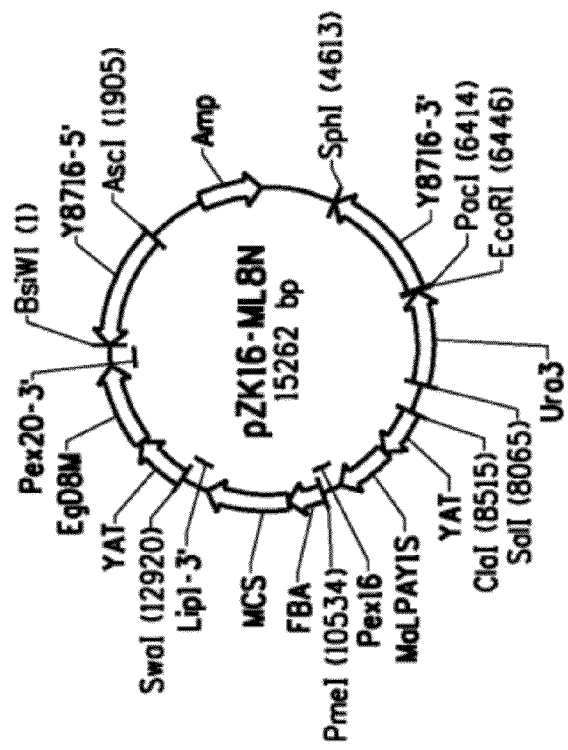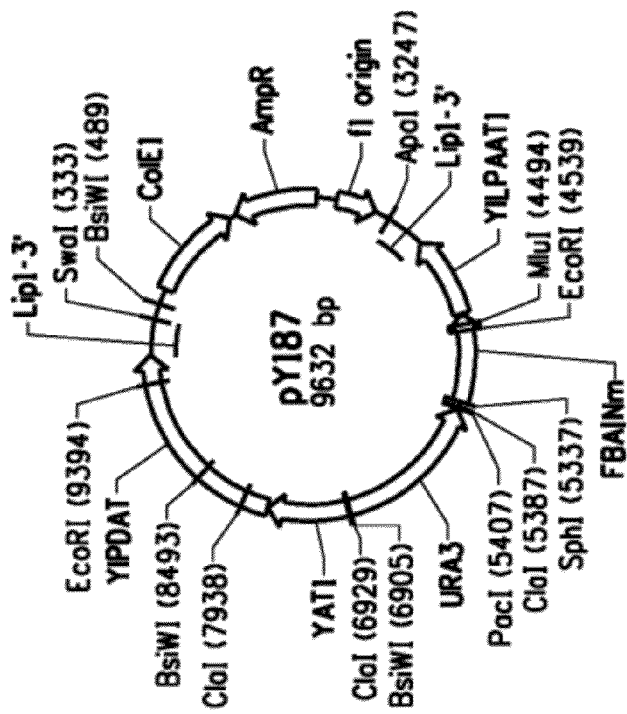
FIG. 5B
FIG. 5A

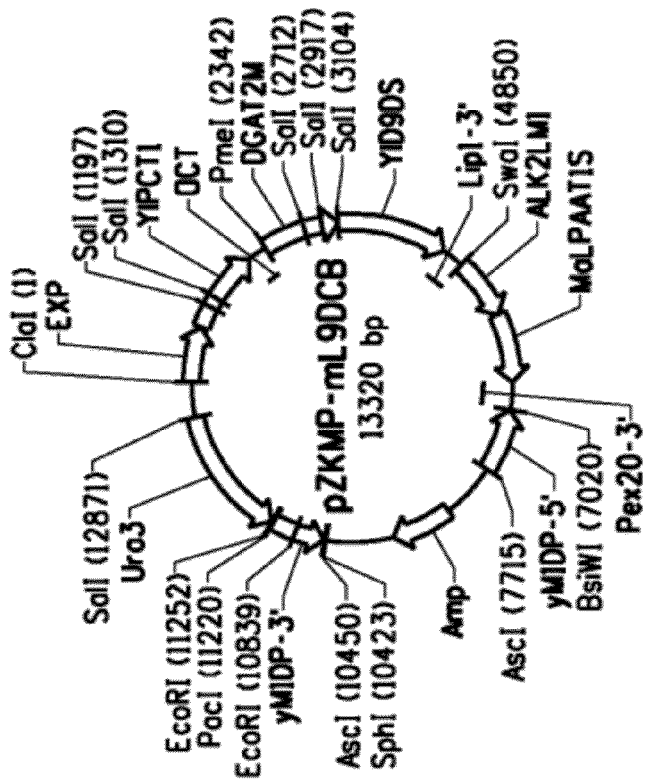
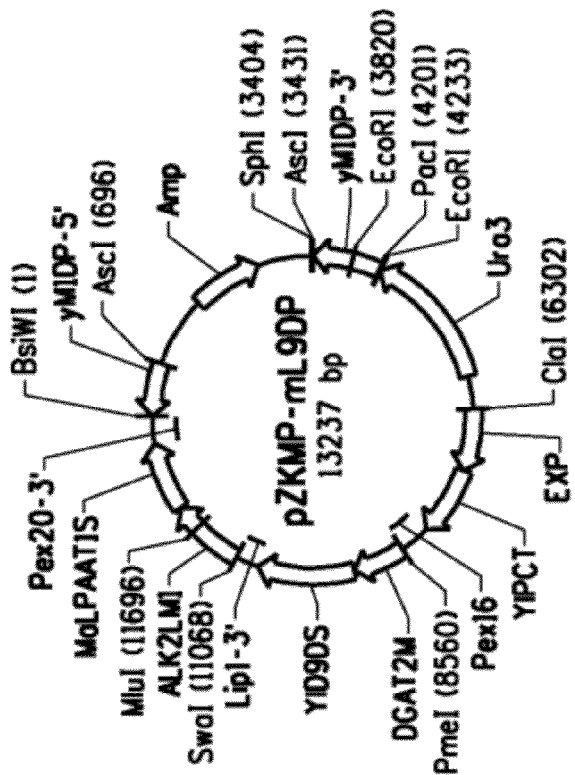
FIG. 7B
FIG. 7A

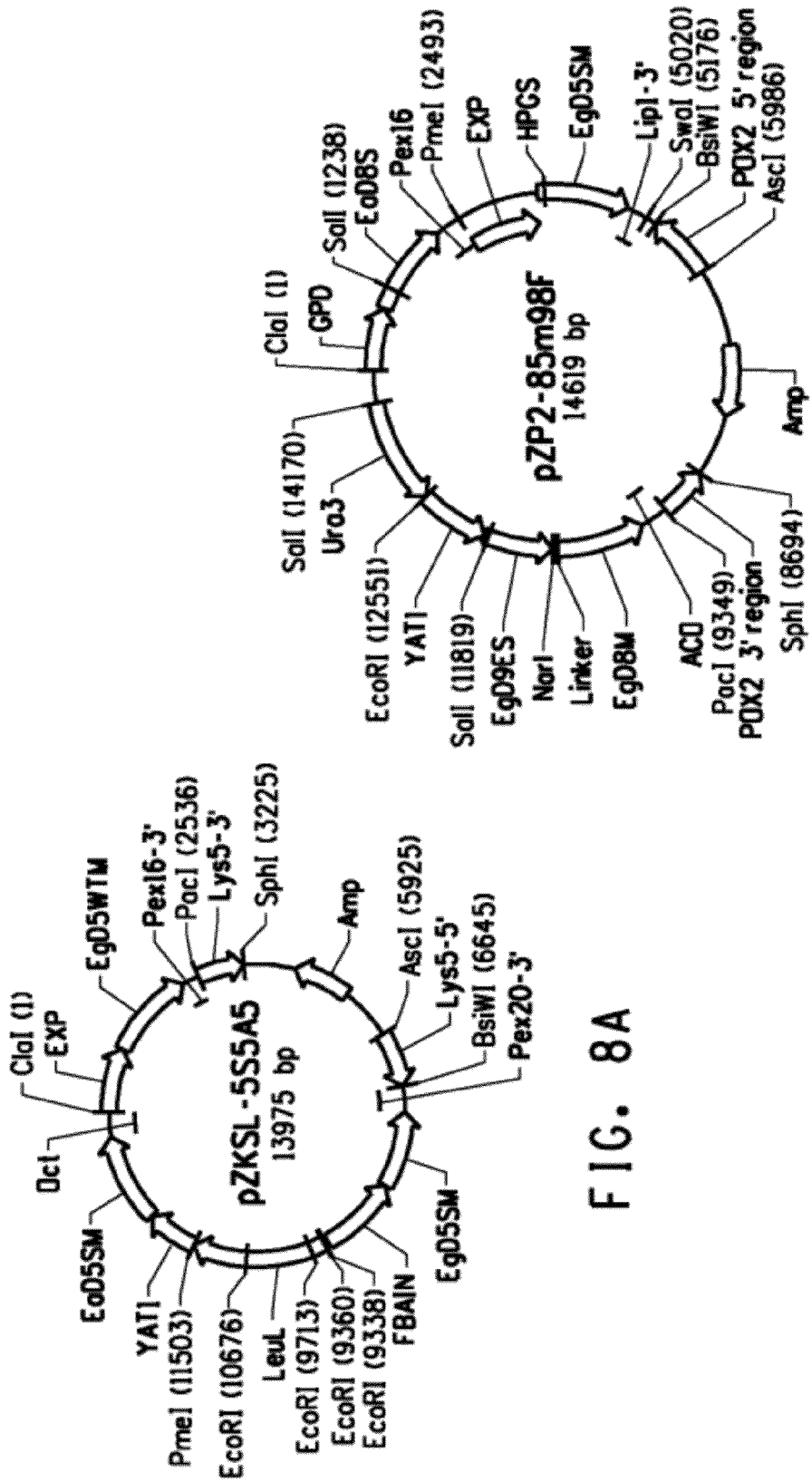

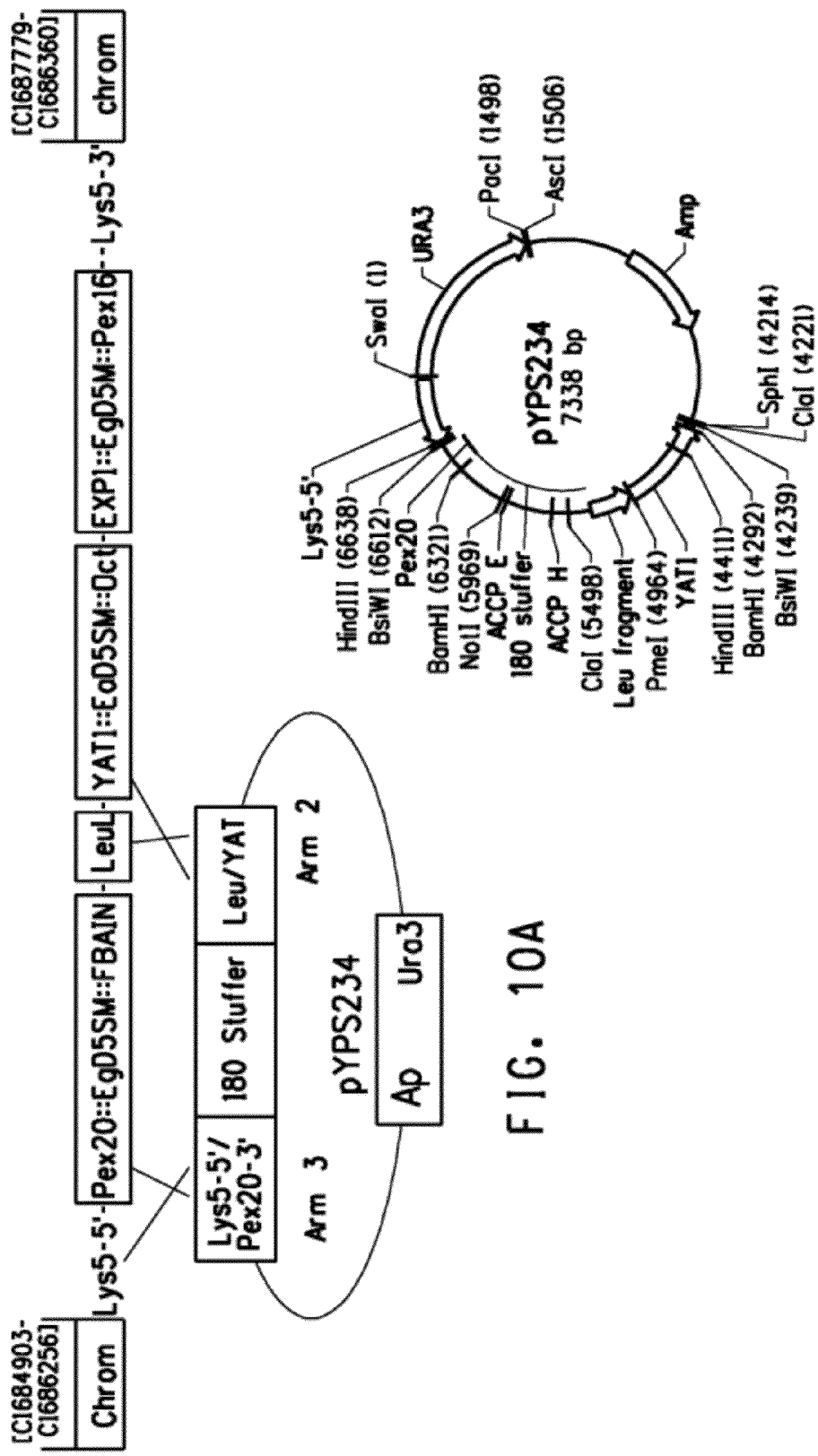

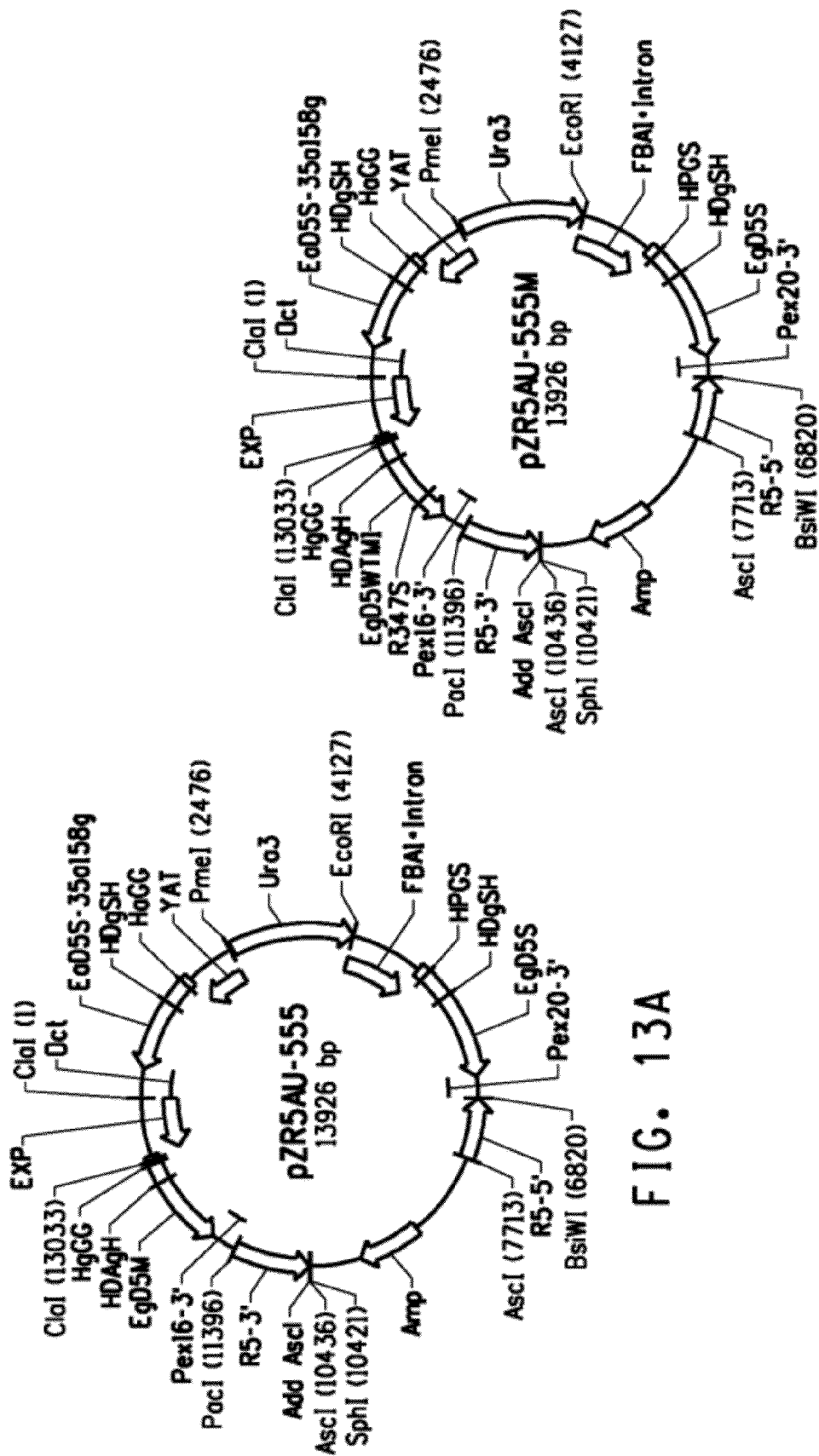

```
                    10         20         30         40         50         60         70
            ....|....|....|....|....|....|....|....|....|....|....|....|....|....|....|
Ci_elo      --------------------------------------------MDVLHRFLGFY------------------    11
Om_elo      --------------------------------------------METFNYKLNMY------------------    11
Mp_elo1     -----------------------------------------MEAYEMVDSFVSKTVFET--------------    18
Pp_elo1     -----------------------------------------MEVERFYGELDGKVSQG---------------    18
Mp_d5e      MATKSGSGLLEWIAVAAKMKQARSSPEGEIVGGNRMGSGNGAEWTTSLIHAFLNATNGKSGGASKVRPLE        70
Ot_elo1     ---------------------------------------MSGLRAPNFLHRFWTKWDYAIS------------    22
Pav_elo2    ---------------------------------------------MMLAAG----------------------     6
Ps_elo2     -----------------------------------MKAAAGKVQQEAERLTAGLWLPMMLAAG---------    28
Ot_elo2     -------------------------------------MSASGALLPAIASAAYAYAT---------------    20
Ea_d9e      -------------------------------------------------------------------------     1
Eg_elo1     -------------------------------------------------------------------------     1
E389_d9e    -------------------------------------------------------------------------     1
Ig_d9e      -------------------------------------------------------------------------     1
Tp_elo2     ----------------------------------MCSSPPSQSKTTSLLARYTTAAL---------------    23
Tp_elo1     ---------------------------------------MDAYNAAMDKIG---------------------    12
Ma_d6e      ---------------------------------MAAAILDKVNFGIDQPFGIKLDTY--------------     24
Th_elo2     ----------------------------------MMEPLDRYRALAELAAR---------------------    17
Trace_1     fhsqshshaakdahahhgfqphgsxkhkaahhpqfhshxhxxxxsxxxxfsxxxxxxhhsgaqXak-------    70
Trace_2     --------------------------------fqhhhhqaxsxxxxaxxhaxxxxfxxax-----------    28
Trace_3     -------------------------------------------------------------------------     1
Trace_4     -----------------------------fxxxxxxxxsxxxxxxxxxxxxxxxf-----------------    24
```

|  |  |  |  |  |  |  |
|---|---|---|---|---|---|---|
| Cl_elo | LSALG------ | -PHMQKFLWKKFLWWKKYITMLQLVQPVLAIYHTARSLYVKCPSP | --------- | --------- | ---VWMHWALI | 239 |
| Om_elo | LSAV------ | -PALRPYLWWKKYITQVLIQFFLTMSQTICAVIWPCDFP | --------- | --------- | ---RGWLYFQI | 236 |
| Mp_elo1 | LAATLGKNEKARRKYLWWGKYLWWGKYLTQLQMFQVLNMIQAYYDIKNNSPYP | --------- | --------- | ---QPLIQILF | 256 |
| Pp_elo1 | LAACLRSSPKLKNKYLPWGRYLTQFQMFQFMINLVQAYYDMKTNAPYP | --------- | --------- | ---QWLIKILF | 258 |
| Mp_d5e | LAATVARDEKRRKYLFWGKYLTIIQMLQFLSFIGQAIYAMWKFEYYP | --------- | --------- | ---KGFGRMLF | 318 |
| Ot_elo1 | LSTLIGKEDPKRSNYLWWGRHITQMQMLQFFFNVLQALYCAS-FSTYP | --------- | --------- | ---KFLSKILL | 263 |
| Pav_elo2 | MALLG------ | -WSCPWKRYLTQAQLVQFCICLAHSTWAAV-TGAYP | --------- | --------- | ---WRICLVEV | 234 |
| Ps_elo2 | MALLG------ | -WSCPWKRYLTQAQLVQFCICLAHATWAAA-TGVYP | --------- | --------- | ---FHICLVEI | 256 |
| Ot_elo2 | MSALG------ | -IRCPWKRYITQAQMLQFVIVFAHAVFVLR-QKHCP | --------- | --------- | ---VTLPWAQM | 250 |
| Ea_d9e | TRLIK------ | -INFPMPKNLITSMQIIQFNVGFYIVWKYRNVPCYRQDG | --------- | --------- | ---MRMFAWIFNY | 228 |
| Bg_elo1 | TRLIK------ | -IKFPMPKSLITSMQIIQFNVGFYIVWKYRNIPCYRQDG | --------- | --------- | ---MRMFGWFFNY | 228 |
| E389_d9e | TRLMK------ | -KNFPMPKQLITAMQITQFNVGFYLVWHYKDIPCYRKDP | --------- | --------- | ---MRMLAWIFNY | 232 |
| Ig_d9e | LTAAG------ | -VKLFKA-KPLITAMQICQFVGGFLLVWDYINVPCFNSDK | --------- | --------- | ---GKLFSWAFNY | 232 |
| Tp_elo2 | LALLK------ | -VSCPWKRYLTQAQLLQFTSVVVTGCTGTYTHYHTKHGADETQPSLGTYFCCGVQV | --------- | ---LRITIVYF | 273 |
| Tp_elo1 | ICMHTKDSKTGKSLPIWWKSSLTAFQLLQFTIMMSQATYLVFHGCDKVS | --------- | --------- | ---LRITIVYF | 245 |
| Ma_d6e | RSAAG------ | -VRIWWKQYLTTLQIVQFVLDLGFIYFCAYTYFAFTYFPWAPNVGKCAGTEGAALFGC | 265 |
| Th_elo2 | RPFPKG----- | -LRPLITQLQIVQFIFSIGIHTAIYWHYDCEPLVHT | --------- | --------- | ---HFWEYVTPY | 243 |
| Trace_1 | LXXXXXssXXXKsXdLdWxqxaTXfXQfEfQFfXXfXsXXXXXXXXXP | --------- | --------- | ---XXfXXXXXf | 323 |
| Trace_2 | MXXLG------ | -fsCPWKRYaTQAQfaQFfffAHXdXXX-sXXfP | --------- | --------- | ---fsaXfXsf | 260 |
| Trace_3 | XsXXX------ | -fsFXXXKLITXMQIXQFXXQGFfaVWXYXsaPCdsSDX | --------- | --------- | ---XqfXWXFNY | 249 |
| Trace_4 | XXXXXkxqshqsaXfXfqXXaTXXQaaQFXXXfXXXXXXXXXdsXXXXXXXXsXXsfhXXXXXXXXXf | 285 |

FIG. 15E

```
               360        370        380        390        400        410        420
               |....|....|....|....|....|....|....|....|....|....|....|....|....|....|
Cl_elo         LYAFSPILLFSNFYMHAYIKKSRKGK----ENGSRG-------KGGVSNGKEKLHANGKTD--------  289
Om_elo         FYVITLIALFSNFYIQTYKKHLVSQKKEYHQNGSVASLNGHVNGVTPTETITHRKVRGD--------  295
Mp_elo1        YMISLLALFGNFYVHKYVSAPAKPAKIKSKKAE---------------------------------  290
Pp_elo1        YMISLLLFLFGNFYVQKYIKP--SDGKGAKTE----------------------------------  290
Mp_d5e         FYSVSLLAPFGNFFVKKYSNA--SQPKTVKE-----------------------------------  348
Ot_elo1        VYMMSLLGLFGHFYYSKHIAA--AKLQKKQQ-----------------------------------  292
Pav_elo2       WVMVSMLVLFTRFYRQAYAKE----AKAKBAKK---------LAQEASQAKAVKAE----------  277
Ps_elo2        WVMSMLYLFTKFYNSAYKGA-----AKGAAASSNG-------AAAPSGAKPKSIKAN---------  302
Ot_elo2        FVMTNMLVLFGNFYLKAYSNK----SRGDGASSVKPAETTRAPSVRRTRSRKID------------  300
Ea_d9e         WYVGTVLLLFLNFYVQTYIRK----PRKNRGKKE--------------------------------  258
Eg_elo1        FYVGTVLCLFLNFYVQTYIVR----KHKGAKKIQ--------------------------------  258
E389_d9e       WYVGTVLLLFINFFVKSYVFP----KPKTADKKVQ-------------------------------  263
Ig_d9e         AYVGSVFLLFCHFFQDNLAT-----KKSAKAGKQL-------------------------------  263
Tp_elo2        FEMVSLFLSIFYKRSYSKKNKSGGEDSKKNDDGNNEDQCHRAMKDISEGAKEVGHAAKDAGKLVATA 343
Tp_elo1        VSLLSLFFLFAQFFVQSYMAP----KKKKSA-----------------------------------  272
Ma_d6e         GLLSSYLLLFINFYRITYNAK----AKAAKERGSNFTPKTVKSGGGSPKKPSKSKHI----------  317
Th_elo2        LFVVPFLILFLNFYLQQYVLAP---AKTKKA-----------------------------------  271
Trace_1        fYXfsfaXfPXsFdfsYXXsXXXXsXXXXsXhsaphqXXhasXXqsXQxXsXqXk-----------  382
Trace_2        dVMXsMLfLFXsFYXsAYXXX----XqhXXAasXXXhksXXAXsXXsXqXXKXs------------  310
Trace_3        XYVGsVffLFfsfRdfssXaXX---XXsXXXXXXX-------------------------------  280
Trace_4        XXfXXffffLFXXfdXXsYXXXqshXfXXsXXsXXssfqshXsXXsXXXsXahqhhqkhhqaahsh  355
                                    *
                              |----TM4----|
```

FIG. 15F

```
                    430
            ....|....|
Ci_elo      ---------- 289
Om_elo      ---------- 295
Mp_elo1     ---------- 290
Pp_elo1     ---------- 290
Mp_d5e      ---------- 348
Ot_elo1     ---------- 292
Pav_elo2    ---------- 277
Ps_elo2     ---------- 302
Ot_elo2     ---------- 300
Ea_d9e      ---------- 258
Eg_elo1     ---------- 258
E389_d9e    ---------- 263
Ig_d9e      ---------- 263
Tp_elo2     SKAVKRKGTRVTGAM 358
Tp_elo1     ---------- 272
Ma_d6e      ---------- 317
Th_elo2     ---------- 271
Trace_1     ---------- 382
Trace_2     ---------- 310
Trace_3     ---------- 280
Trace_4     sqhaqqqhsqashhf 370
```

FIG. 15G

Abbreviations

Ci_elo = SEQ ID NO:133
Mp_elo1 = SEQ ID NO:135
Mp_d5e = SEQ ID NO:137
Pav_elo2 = SEQ ID NO:139
Ot_elo2 = SEQ ID NO:141
Eg_d9e = SEQ ID NO:32
Ig_d9e = SEQ ID NO:42
Tp_elo1 = SEQ ID NO:143
Th_elo2 = SEQ ID NO:145
Om_elo = SEQ ID NO:134
Pp_elo1 = SEQ ID NO:136
Ot_elo1 = SEQ ID NO:138
Ps_elo2 = SEQ ID NO:140
Ea_d9e = SEQ ID NO:34
E398_d9e = SEQ ID NO:38
Tp_elo2 = SEQ ID NO:142
Ma_d6e = SEQ ID NO:144

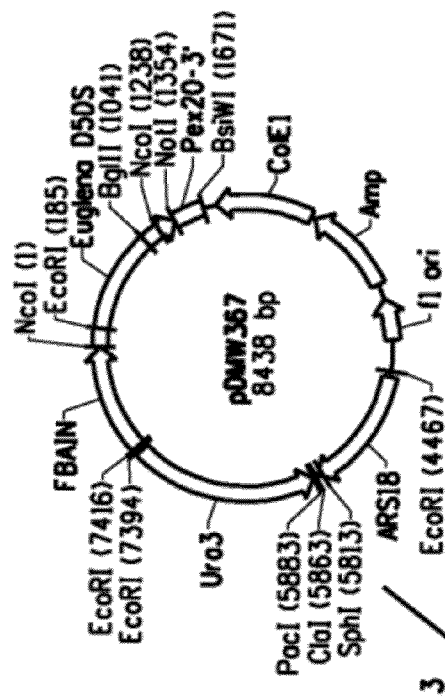
FIG. 20A
FIG. 20B
FIG. 20C

FIG. 21

EgD5R (SEQ ID NO:192)  ATGGCTCTCAGTCTTACCACAGAACAGCTGTTAGAACGCCCTGATTTGGTTGCGATTTGAT
EgD5M (SEQ ID NO:105)  ATGGCCCTGTCTCTCACTACCGAACACAGTCCTGGAGCGACCTGATCTCGTCGCTGATCGAT

EgD5R (SEQ ID NO:192)  GGCATCCTCTACGACCTTGAAGGGCTTGCCAAAGTTCATCCAGGAGGAGATTTGATTCTC
EgD5M (SEQ ID NO:105)  GGTATCCTGTACGACCTGGAGGACCTGGCCAAGGTGCATGGTGGAGACCTCATTCTG

EgD5R (SEQ ID NO:192)  GCTTCTGGTGCCTCTGATGCCTCCCCTCTTTATTCAATGCATCCTATACGTCAAACCG
EgD5M (SEQ ID NO:105)  GCCCTCGGAGCCTCCGACGCCTCTCCCCTCTCCCTCTACTCTATGCATCCTACGTCAAGCCC

EgD5R (SEQ ID NO:192)  GAGAATTCCAAAATTGCTTCAACAGTTCGTCCGAGGGAAGCATGACCGCACCTGAAGGAC
EgD5M (SEQ ID NO:105)  GAGAACTCCAAGTCCTGCAGCAATTCGTCCGAGGGAAGCATGACCGCACCTGAAGGAC

RECOMBINANT MICROBIAL HOST CELLS FOR HIGH EICOSAPENTAENOIC ACID PRODUCTION

This application claims the benefit of U.S. Provisional Application No. 61/377,248, filed Aug. 26, 2010, U.S. Provisional Application No. 61/428,277, filed Dec. 30, 2010, and U.S. Provisional Application No. 61/479,921, filed Apr. 28, 2011, each of which is hereby incorporated by reference in their entirety.

FIELD OF THE INVENTION

This invention is in the field of biotechnology. More specifically, this invention pertains to engineered recombinant microbial host cells that are capable of efficiently producing eicosapentaenoic acid, an omega-3 polyunsaturated fatty acid ["PUFA"], in high concentrations.

BACKGROUND OF THE INVENTION

The clinical and pharmaceutical value of eicosapentaenoic acid ["EPA"; cis-5,8,11,14,17-eicosapentaenoic acid; omega-3] is well known (U.S. Pat. Appl. Pub. No. 2009-0093543-A1). Similarly, the advantages of producing EPA in microbes using recombinant means, as opposed to producing EPA from natural microbial sources or via isolation from fish oil and marine plankton, are also well recognized.

Although the literature reports a number of recent examples whereby various portions of the omega-3/omega-6 polyunsaturated fatty acid ["PUFA"] biosynthetic pathway, responsible for EPA production, have been introduced into plants and non-oleaginous yeast, significant efforts by the Applicants' Assignee has focused on the use of the oleaginous yeast, *Yarrowia lipolytica* (U.S. Pat. No. 7,238,482; U.S. Pat. No. 7,932,077; U.S. Pat. Appl. Pub. No. 2009-0093543-A1; U.S. Pat. Appl. Pub. No. 2010-0317072-A1). Oleaginous yeast are defined as those yeast that naturally are capable of oil synthesis and accumulation, wherein oil accumulation is at least 25% of the cellular dry weight, or those yeast genetically engineered such that they become capable of oil synthesis and accumulation, wherein oil accumulation is at least 25% of the cellular dry weight.

More specifically, U.S. Pat. No. 7,932,077 demonstrated production of 9% EPA of total fatty acids ["TFAs"] in a recombinant *Yarrowia lipolytica* strain without co-synthesis of gamma-linolenic acid ["GLA"; omega-6], by expression of the following genes: delta-9 elongase, delta-8 desaturase, delta-5 desaturase, delta-17 desaturase, delta-12 desaturase and $C_{16/18}$ elongase.

U.S. Pat. Appl. Pub. No. 2009-0093543-A1 describes optimized recombinant *Yarrowia lipolytica* strains producing up to 55.6% EPA of TFAs in a recombinant *Y. lipolytica* strain by expression of the following genes: delta-9 elongase, delta-8 desaturase, delta-5 desaturase, delta-17 desaturase, delta-12 desaturase, $C_{16/18}$ elongase and diacylglycerol cholinephosphotransferase.

U.S. Pat. Appl. Pub. No. 2010-0317072-A1 describes further optimized recombinant *Yarrowia lipolytica* strains producing microbial oils comprising up to 50% EPA of TFAs and having a ratio of at least 3.1 of EPA, measured as a weight percent of TFAs, to linoleic acid, measured as a weight percent of TFAs. In addition to expressing genes of the omega-3/omega-6 fatty acid biosynthetic pathway as detailed in U.S. Pat. Appl. Pub. No. 2009-0093543-A1, these improved strains are distinguished by:

1) comprising at least one multizyme, wherein said multizyme comprises a polypeptide having at least one fatty acid delta-9 elongase linked to at least one fatty acid delta-8 desaturase [a "DGLA synthase"];
2) optionally comprising at least one polynucleotide encoding an enzyme selected from the group consisting of a malonyl CoA synthetase or an acyl-CoA lysophospholipid acyltransferase ["LPLAT"]; and,
3) comprising at least one peroxisome biogenesis factor protein whose expression has been down-regulated.

Despite the disclosures cited above, strain improvements are necessary for commercial production of EPA that will permit production of high EPA as a weight percent of the total fatty acids in addition to high total lipid content (i.e., high EPA productivity), while minimizing production of intermediate fatty acids, such as linoleic acid ["LA"; omega-6], and byproduct fatty acids in the final oil product. Applicants have solved the stated problem by engineering improved optimized strains of *Yarrowia lipolytica*, wherein the improvement enables production of microbial oil comprising at least 25 weight percent of EPA measured as a weight percent of dry cell weight.

SUMMARY OF THE INVENTION

In a first embodiment, the invention concerns a recombinant microbial host cell producing an oil comprising at least 25 weight percent of eicosapentaenoic acid measured as a weight percent of dry cell weight.

In a second embodiment, disclosed herein is an oil comprising at least 45 weight percent of eicosapentaenoic acid measured as a weight percent of total fatty acids.

Preferably, either of the oils supra has a ratio of at least 2.4 of eicosapentaenoic acid, measured as a weight percent of total fatty acids, to linoleic acid, measured as a weight percent of total fatty acids.

In a third embodiment, disclosed herein is a recombinant microbial host cell comprising:
(a) at least one multizyme which comprises a polypeptide having at least one delta-9 elongase linked to at least one delta-8 desaturase;
(b) at least one peroxisome biogenesis factor protein whose expression has been down-regulated; and,
(c) at least two polypeptides having at least lysophosphatidic acid acyltransferase ["LPAAT"] activity;
(d) at least one polypeptide having at least phospholipid: diacylglycerol acyltransferase ["PDAT"] activity.

In a fourth embodiment, the recombinant microbial host cell may further comprise at least one mutant delta-9 elongase polypeptide, wherein said mutant delta-9 elongase polypeptide comprises an amino acid sequence as set forth in SEQ ID NO:1, wherein SEQ ID NO:1 differs from SEQ ID NO:3 by at least one amino acid mutation, said mutation(s) selected from the group consisting of:
i) a L35F mutation;
ii) a L35M mutation;
iii) a L35G mutation;
iv) a L35G mutation and at least one other mutation selected from the group consisting of: S9A, S9D, S9G, S9I, S9K, S9Q, Q12K, A21D, A21T, A21V, V32F, Y84C, Q107E, L108G, G127L, W132T, M143N, M143W, L161T, L161Y, W168G, I179M, I179R, C236N, Q244N, A254W and A254Y;
v) L35G, A21V, L108G and I179R mutations;
vi) L35G, W132T and I179 mutations;
vii) L35G, S9D, Y84C and I179R mutations;
viii) L35G, Y84C, I179R and Q244N mutations;

ix) L35G, A21V, W132T, I179R and Q244N mutations;
x) K58R and I257T mutations;
xi) a D98G mutation;
xii) L130M and V243A mutations; and,
xiii) any combination comprising at least two mutations, wherein the mutations are selected from the group consisting of: K58R, L35F, L35G, L35M, S9A, S9D, S9G, S9I, S9K, S9Q, Q12K, A21D, A21T, A21V, V32F, Y84C, D98G, Q107E, L108G, G127L, L130M, W132T, M143N, M143W, L161T, L161Y, W168G, I179M, I179R, C236N, V243A, Q244N, A254W, A254Y and I257T.

Preferably, the at least one mutant delta-9 elongase polypeptide comprises a L35G substitution and the mutant delta-9 elongase polypeptide has improved delta-9 elongase activity when compared to the delta-9 elongase activity of SEQ ID NO:3.

Preferably, the at least one multizyme has a property selected from the group consisting of:
(a) a linker is selected from the group consisting of: SEQ ID NO:4, SEQ ID NO:5, SEQ ID NO:6, SEQ ID NO:7, SEQ ID NO:8, SEQ ID NO:9 and SEQ ID NO:10; and,
(b) an amino acid sequence consisting essentially of a sequence selected from the group consisting of: SEQ ID NO:12, SEQ ID NO:14 and SEQ ID NO:16.

Preferably, at least one of the at least two lysophosphatidic acid acyltransferases is selected from the group consisting of:
(a) an amino acid sequence consisting essentially of a sequence selected from the group consisting of SEQ ID NO:18, SEQ ID NO:20, SEQ ID NO:22, SEQ ID NO:23 and SEQ ID NO:25 and,
(b) a polypeptide having at least 43.9% amino acid identity, based on the Clustal W method of alignment, when compared to an amino acid sequence selected from the group consisting of SEQ ID NO:18, SEQ ID NO:22, SEQ ID NO:23 and further comprising at least one 1-acyl-sn-glycerol-3-phosphate acyltransferase family motif selected from the group consisting of: SEQ ID NO:26 and SEQ ID NO:27.

Preferably, the at least one phospholipid:diacylglycerol acyltransferase is selected from the group consisting of:
(a) an amino acid sequence consisting essentially of a sequence selected from the group consisting of SEQ ID NO:29 and SEQ ID NO:30; and,
(b) a polypeptide having at least 90% amino acid identity, based on the Clustal W method of alignment, when compared to an amino acid sequence selected from the group consisting of SEQ ID NO:29 and SEQ ID NO:30.

Preferably, the host cell is of the genus *Yarrowia*.

In a fifth embodiment, the invention concerns a method for making a microbial oil comprising eicosapentaenoic acid comprising:
a) culturing the host cell of any of the invention wherein a microbial oil comprising eicosapentaenoic acid is produced; and,
b) optionally recovering the microbial oil of step (a)

In a sixth embodiment, the invention concerns further processing of the oil made by the method of the invention.

Biological Deposits

The following biological material has been deposited with the American Type Culture Collection (ATCC), 10801 University Boulevard, Manassas, Va. 20110-2209, and bears the following designation, accession number and date of deposit.

| Biological Material | Accession No. | Date of Deposit |
|---|---|---|
| *Yarrowia lipolytica* Y8412 | ATCC PTA-10026 | May 14, 2009 |

The biological material listed above was deposited under the terms of the Budapest Treaty on the International Recognition of the Deposit of Microorganisms for the Purposes of Patent Procedure. The listed deposit will be maintained in the indicated international depository for at least 30 years and will be made available to the public upon the grant of a patent disclosing it. The availability of a deposit does not constitute a license to practice the subject invention in derogation of patent rights granted by government action.

*Yarrowia lipolytica* Y9502 was derived from *Yarrowia lipolytica* Y8412, according to the methodology described in U.S. Pat. Appl. Pub. No. 2010-0317072-A1.

BRIEF DESCRIPTION OF THE DRAWINGS AND SEQUENCE DESCRIPTIONS

FIG. 1A and FIG. 1B illustrate the omega-3/omega-6 fatty acid biosynthetic pathway, and should be viewed together when considering the description of this pathway below.

FIG. 2 graphically shows the relationship between EPA % TFAs and LA % TFAs during the course of a fermentation of *Yarrowia lipolytica* strain Y4305 (U.S. Pat. Appl. Pub. No. 2009-0093543-A1).

FIG. 3A and FIG. 3B diagrams the development of various *Yarrowia lipolytica* strains derived from *Yarrowia lipolytica* ATCC #20362.

FIG. 4 provides plasmid maps of the following: (A) pZKUM; and, (B) pZKL3-9DP9N.

FIG. 5 provides plasmid maps of the following: (A) pY187; and, (B) pZK16-ML8N.

FIG. 6 provides plasmid maps of the following: (A) pZK16-MyL8N; and, (B) pZK16-ML3.

FIG. 7 provides plasmid maps of the following: (A) pZKMP-mL9DP; and, (B) pZKMP-mL9DCB.

FIG. 8 provides a plasmid map of the following: (A) pZKSL-5S5A5; and, (B) pZP2-85m98F.

FIG. 9 illustrates development of various *Yarrowia lipolytica* strains derived from strain Z5567.

FIG. 10A schematically illustrates a homologous recombination reaction with pYPS234, while FIG. 10B provides a plasmid map of pYPS234.

FIG. 11A schematically illustrates a homologous recombination reaction with pYPS233, while FIG. 11B provides a plasmid map of pYPS233.

FIG. 12A schematically illustrates a homologous recombination reaction with pYPS241, while FIG. 12B provides a plasmid map of pYPS241.

FIG. 13 provides a plasmid map of the following: (A) pZR5AU-555; and, (B) pZR5AU-555M.

FIG. 14 is a plasmid map of pZUFmEgD9ES.

FIGS. 15A, 15B, 15C, 15D, 15E, 15F, 15G and 15H are an alignment of seventeen fatty acid elongases from *Ciona intestinalis* [SEQ ID NO:133], *Oncorhynchus mykiss* [SEQ ID NO:134], *Marchantia polymorpha* [SEQ ID NO:135], *Physcomitrella patens* [SEQ ID NO:136], *Marchantia polymorpha* [SEQ ID NO:137], *Ostreococcus tauri* [SEQ ID NO:138], *Pavlova* sp. CCMP459 [SEQ ID NO:139], *Pavlova salina* [SEQ ID NO:140], *Ostreococcus tauri* [SEQ ID NO:141], *Euglena anabaena* [SEQ ID NO:34], *Euglena gracilis* [SEQ ID NO:32], *Eutreptiella* sp. CCMP389 [SEQ ID NO:38], *Isochrysis galbana* [SEQ ID NO:42], *Thalassiosira*

*pseudonana* [SEQ ID NO:142], *Thalassiosira pseudonana* [SEQ ID NO:143], *Mortierella alpina* [SEQ ID NO:144] and *Thraustochytrium* sp. FJN-10 [SEQ ID NO:145] using a ClustalW method of alignment.

FIG. 16A shows a membrane topology model of EgD9eS; each vertical cylinder indicates a membrane-spanning segment, while each horizontal cylinder indicates a hydrophobic stretch that lies in or near the inner membrane leaflet.

FIG. 16B shows a representation of the synthetic mutant delta-9 elongase, derived from *Euglena gracilis* (i.e., "EgD9eS-mutant consensus"; SEQ ID NO:1) optionally comprising: a L35F mutation; a L35M mutation; a L35G mutation; a L35G mutation and at least one other mutation selected from the group consisting of: S9A, S9D, S9G, S9I, S9K, S9Q, Q12K, A21D, A21T, A21V, V32F, Y84C, Q107E, L108G, G127L, W132T, M143N, M143W, L161T, L161Y, W168G, I179M, I179R, C236N, Q244N, A254W and A254Y; L35G, A21V, L108G and I179R mutations; L35G, W132T and I179R mutations; L35G, S9D, Y84C and I179R mutations; L35G, Y84C, I179R and Q244N mutations; L35G, A21V, W132T, I179R and Q244N mutations; K58R and I257T mutations; a D98G mutation; L130M and V243A mutations; and, any combination comprising at least two mutations, wherein the mutations are selected from the group consisting of: K58R, L35F, L35G, L35M, S9A, S9D, S9G, S9I, S9K, S9Q, Q12K, A21D, A21T, A21V, V32F, Y84C, D98G, Q107E, L108G, G127L, L130M, W132T, M143N, M143W, L161T, L161Y, W168G, I179M, I179R, C236N, V243A, Q244N, A254W, A254Y and I257T.

FIG. 17 is an alignment of the delta-9 elongases of *Isochrysis galbana* ["IgD9e"] (SEQ ID NO:42), *Eutreptiella* sp. CCMP389 ["E389D9e"] (SEQ ID NO:38), *Euglena gracilis* ["EgD9e"] (SEQ ID NO:32) and *E. anabaena* ["EaD9e"] (SEQ ID NO:34) using Vector NTI®'s AlignX program (Invitrogen Corporation, Carlsbad, Calif.).

Figure 19B:
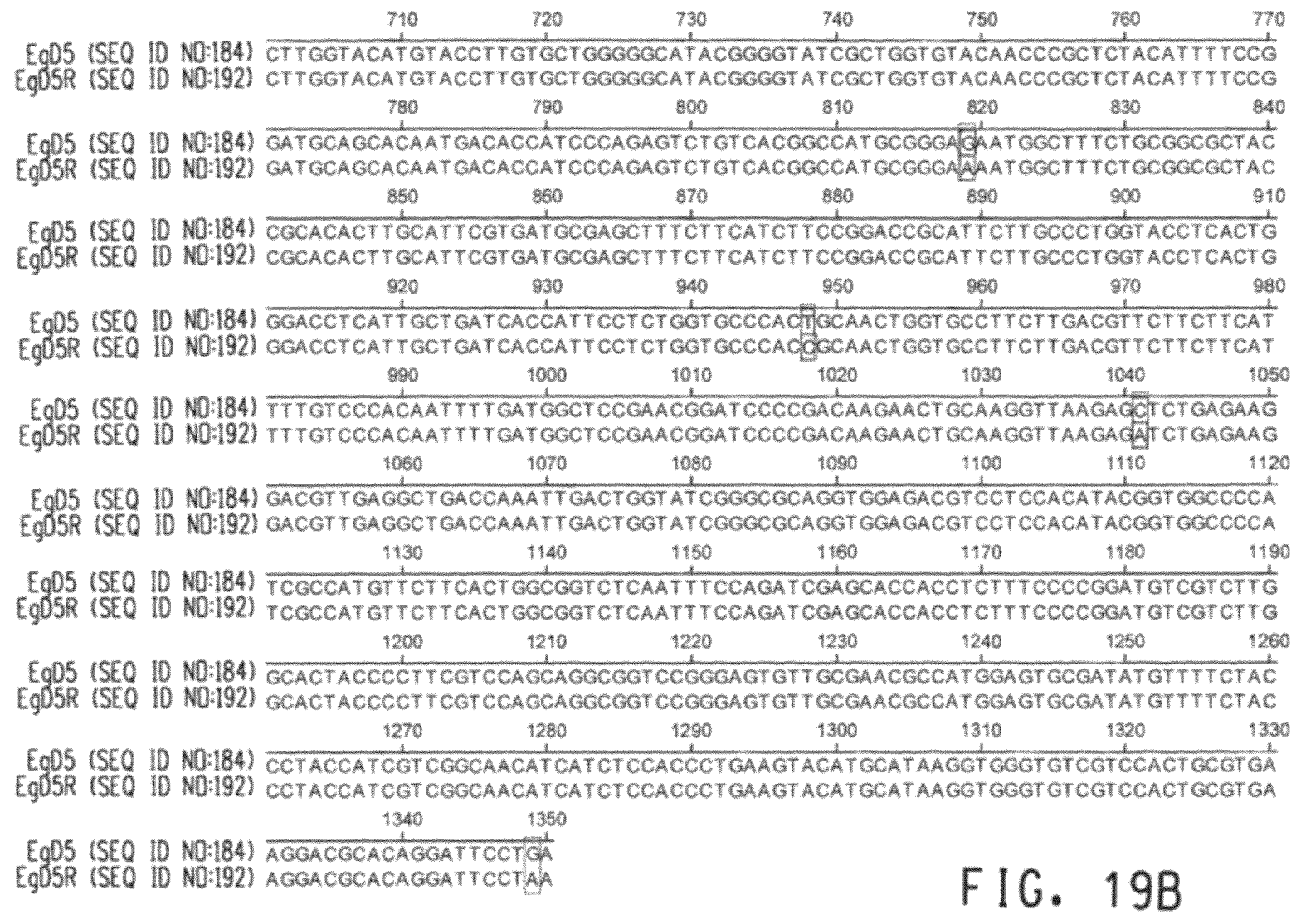

FIGS. 19A and 19B show an alignment of the DNA sequences of the wildtype delta-5 desaturase gene from *Euglena gracilis* (i.e., EgD5; SEQ ID NO:184) with a variant wildtype *E. gracilis* delta-5 desaturase gene that contains a S347R mutation (i.e., EgD5R; SEQ ID NO:192).

FIGS. 20A, 20B and 20C illustrate construction of plasmid pDMW367-M4.

FIG. 21 shows a sequence alignment of a 5' portion of the wildtype delta-5 desaturase gene from *E. gracilis* (i.e., EgD5R; SEQ ID NO:192) with the first 204 bp of the *Yarrowia lipolytica* codon-optimized delta-5 desaturase mutant gene (i.e., EgD5M; SEQ ID NO:105).

Figure 22A:
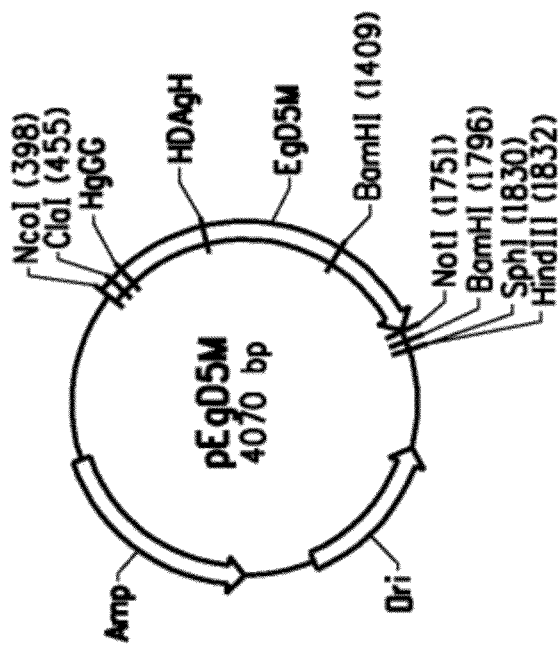
Figure 22B:
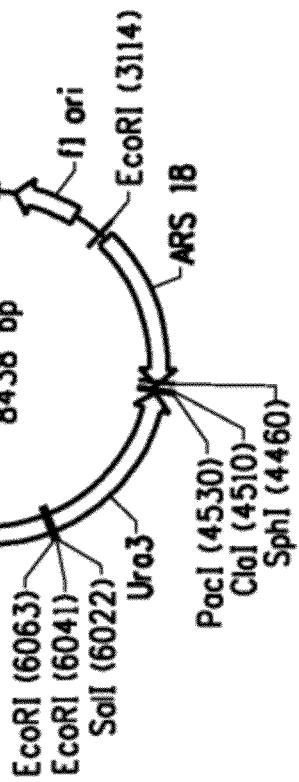

FIG. 22 provides plasmid maps for the following: (A) pEgD5M; and, (B) pDMW367-5M.

The invention can be more fully understood from the following detailed description and the accompanying sequence descriptions, which form a part of this application.

The following sequences comply with 37 C.F.R. §1.821-1.825 ("Requirements for Patent Applications Containing Nucleotide Sequences and/or Amino Acid Sequence Disclosures—the Sequence Rules") and are consistent with World Intellectual Property Organization (WIPO) Standard ST.25 (1998) and the sequence listing requirements of the EPO and PCT (Rules 5.2 and 49.5(a-bis), and Section 208 and Annex C of the Administrative Instructions). The symbols and format used for nucleotide and amino acid sequence data comply with the rules set forth in 37C.F.R. §1.822.

SEQ ID NOs:1-437 are ORFs encoding promoters, genes or proteins (or fragments thereof), primers or plasmids, as identified in Table 1.

TABLE 1

Summary of Gene and Protein SEQ ID Numbers

| Description | Nucleic acid SEQ ID NO. | Protein SEQ ID NO. |
|---|---|---|
| Synthetic mutant delta-9 elongase, derived from *Euglena gracilis* ("EgD9eS-mutant consensus") optionally comprising: a L35F mutation; a L35M mutation; a L35G mutation; a L35G mutation and at least one other mutation selected from the group consisting of: S9A, S9D, S9G, S9I, S9K, S9Q, Q12K, A21D, A21T, A21V, V32F, Y84C, Q107E, L108G, G127L, W132T, M143N, M143W, L161T, L161Y, W168G, I179M, I179R, C236N, Q244N, A254W and A254Y; L35G, A21V, L108G and I179R mutations; L35G, W132T and I179R mutations; L35G, S9D, Y84C and I179R mutations; L35G, Y84C, I179R and Q244N mutations; L35G, A21V, W132T, I179R and Q244N mutations; K58R and I257T mutations; a D98G mutation; L130M and V243A mutations; and, any combination comprising at least two mutations, wherein the mutations are selected from the group consisting of: K58R, L35F, L35G, L35M, S9A, S9D, S9G, S9I, S9K, S9Q, Q12K, A21D, A21T, A21V, V32F, Y84C, D98G, Q107E, L108G, G127L, L130M, W132T, M143N, M143W, L161T, L161Y, W168G, I179M, I179R, C236N, V243A, Q244N, A254W, A254Y and I257T | — | 1 (258 AA) |
| Synthetic delta-9 elongase, derived from *Euglena gracilis*, codon-optimized for expression in *Yarrowia lipolytica* ("EgD9eS") | 2 (777 bp) | 3 (258 AA) |
| Multizyme linker GAGPARPAGLPPATYYDSLAVMGS | — | 4 |
| Multizyme linker GPARPAGLPPATYYDSLAV | — | 5 |

TABLE 1-continued

Summary of Gene and Protein SEQ ID Numbers

| Description | Nucleic acid SEQ ID NO. | Protein SEQ ID NO. |
|---|---|---|
| Multizyme linker PARPAGLPPATYYDSLAV | — | 6 |
| Multizyme linker PTRPAGPPPATYYDSLAV | — | 7 |
| Multizyme linker PGGPGKPSEIASLPPPIRPVGNPPAAYYDALAT | — | 8 |
| Multizyme linker PARPAGLPPATYYDSLAVSGRT | — | 9 |
| Multizyme linker PGGPGKPSEIASLPPPIRPVGNPPAAYYDALATGRT | — | 10 |
| DGLA synthase, comprising EgD9eS/EgD8M gene fusion | 11 (2112 bp) | 12 (703 AA) |
| DGLA synthase, comprising EaD9eS/EaD8S gene fusion | 13 (2109 bp) | 14 (702 AA) |
| DGLA synthase, comprising E389D9eS/EgD8M gene fusion | 15 (2127 bp) | 16 (708 AA) |
| *Mortierella alpina* lysophosphatidic acid acyltransferase ("MaLPAAT1") | 17 (945 bp) | 18 (314 AA) |
| Synthetic LPAAT1 derived from *Mortierella alpina*, codon-optimized for expression in *Yarrowia lipolytica* ("MaLPAAT1S") | 19 (955 bp) | 20 (314 AA) |
| *Yarrowia lipolytica* lysophosphatidic acid acyltransferase ("YlLPAAT1") | 21 (849 bp) | 22 (282 AA) |
| *Saccharomyces cerevisiae* lysophosphatidic acid acyltransferase ("ScLPAAT"; also ORF "YDL052C"; GenBank Accession No. NP_010231) | — | 23 (303 AA) |
| Synthetic LPAAT derived from *Saccharomyces cerevisiae*, codon-optimized for expression in *Yarrowia lipolytica* ("ScLPAATS") | 24 (926 bp) | 25 (303 AA) |
| 1-acyl-sn-glycerol-3-phosphate acyltransferase motif NHxxxxD | — | 26 |
| 1-acyl-sn-glycerol-3-phosphate acyltransferase motif EGTR | — | 27 |
| *Yarrowia lipolytica* phospholipid:diacylglycerol acyltransferase ("YlPDAT") | 28 (1947 bp) | 29 (648 AA) |
| *Saccharomyces cerevisiae* PDAT (GenBank Accession No. P40345) | — | 30 (661 AA) |
| *Euglena gracilis* delta-9 elongase ("EgD9e") | 31 (777 bp) | 32 (258 AA) |
| *Euglena anabaena* delta-9 elongase ("EaD9e") | 33 (774 bp) | 34 (258 AA) |
| Synthetic delta-9 elongase, derived from *Euglena anabaena*, codon-optimized for expression in *Yarrowia lipolytica* ("EaD9eS") | 35 (774 bp) | 36 (258 AA) |
| *Eutreptiella* sp. CCMP389 delta-9 elongase ("E389D9e") | 37 (792 bp) | 38 (263 AA) |
| Synthetic delta-9 elongase, derived from *Eutreptiella* sp. CCMP389 delta-9 elongase, codon-optimized for expression in *Yarrowia lipolytica* ("E389D9eS") | 39 (792 bp) | 40 (263 AA) |
| *Isochrysis galbana* delta-9 elongase ("IgD9e") | 41 (1064 bp) | 42 (263 AA) |
| Synthetic mutant delta-9 elongase derived from *Euglena gracilis* ("EgD9eS-L35G") | 43 (777 bp) | 44 (258 AA) |

TABLE 1-continued

Summary of Gene and Protein SEQ ID Numbers

| Description | Nucleic acid SEQ ID NO. | Protein SEQ ID NO. |
|---|---|---|
| *Yarrowia lipolytica* cholinephosphate cytidylyltransferase gene ("YlPCT") | 45 (1101 bp) | 46 (366 AA) |
| *Yarrowia lipolytica* diacylglycerol cholinephosphotransferase gene ("YlCPT1") | 47 (1185 bp) | 48 (394 AA) |
| Synthetic malonyl-CoA synthetase derived from *Rhizobium leguminosarum* bv. *viciae* 3841 (GenBank Accession No. YP_766603), codon-optimized for expression in *Yarrowia lipolytica* ("MCS") | 49 (1518 bp) | 50 (505 AA) |
| *Yarrowia lipolytica* Pex1p (GenBank Accession No. CAG82178) | — | 51 (1024 AA) |
| *Yarrowia lipolytica* Pex2p (GenBank Accession No. CAG77647) | — | 52 (381 AA) |
| *Yarrowia lipolytica* Pex3p (GenBank Accession No. CAG78565) | — | 53 (431 AA) |
| *Yarrowia lipolytica* Pex3Bp (GenBank Accession No. CAG83356) | — | 54 (395 AA) |
| *Yarrowia lipolytica* Pex4p (GenBank Accession No. CAG79130) | — | 55 (153 AA) |
| *Yarrowia lipolytica* Pex5p (GenBank Accession No. CAG78803) | — | 56 (598 AA) |
| *Yarrowia lipolytica* Pex6p (GenBank Accession No. CAG82306) | — | 57 (1024 AA) |
| *Yarrowia lipolytica* Pex7p (GenBank Accession No. CAG78389) | — | 58 (356 AA) |
| *Yarrowia lipolytica* Pex8p (GenBank Accession No. CAG80447) | — | 59 (671 AA) |
| *Yarrowia lipolytica* Pex10p (GenBank Accession No. CAG81606) | — | 60 (377 AA) |
| *Yarrowia lipolytica* Pex12p (GenBank Accession No. CAG81532) | — | 61 (408 AA) |
| *Yarrowia lipolytica* Pex13p (GenBank Accession No. CAG81789) | — | 62 (412 AA) |
| *Yarrowia lipolytica* Pex14p (GenBank Accession No. CAG79323) | — | 63 (380 AA) |
| *Yarrowia lipolytica* Pex16p (GenBank Accession No. CAG79622) | — | 64 (391 AA) |
| *Yarrowia lipolytica* Pex17p (GenBank Accession No. CAG84025) | — | 65 (225 AA) |
| *Yarrowia lipolytica* Pex19p (GenBank Accession No. AAK84827) | — | 66 (324 AA) |
| *Yarrowia lipolytica* Pex20p (GenBank Accession No. CAG79226) | — | 67 (417 AA) |
| *Yarrowia lipolytica* Pex22p (GenBank Accession No. CAG77876) | — | 68 (195 AA) |
| *Yarrowia lipolytica* Pex26p (GenBank Accession No. NC_006072, antisense translation of nucleotides 117230-118387) | — | 69 (386 AA) |
| Codon-optimized translation initiation site for genes optimally expressed in *Yarrowia* sp. | 70 (10 bp) | — |
| His-rich motif: $Q(X)_2HH$ | — | 71 |
| His-rich motif: $H(X)_2HH$ | — | 72 |

TABLE 1-continued

Summary of Gene and Protein SEQ ID Numbers

| Description | Nucleic acid SEQ ID NO. | Protein SEQ ID NO. |
|---|---|---|
| Delta-9 Elongase Motif #1: Y-N-X-(L or F)-$X_4$-S-$X_2$-S-F | — | 73 |
| Delta-9 Elongase Motif #2: F-Y-X-S-K-$X_2$-(E or D)-Y-X-D-(T or S)-$X_2$-L | — | 74 |
| Delta-9 Elongase Motif #3: L-(Q or H)-X-F-H-H-X-G-A | — | 75 |
| Delta-9 Elongase Motif #4: M-Y-X-Y-Y-$X_7$-(K or R or N)-F | — | 76 |
| Delta-9 Elongase Motif #5: K-X-L-(I or L or M)-T-$X_2$-Q | — | 77 |
| Delta-9 Elongase Motif #6: W-X-F-N-Y-X-Y | — | 78 |
| Delta-9 Elongase Motif #7: Y-X-G-X-V-$X_2$-L-F | — | 79 |
| *Yarrowia lipolytica* delta-9 desaturase gene ("YID9") | 80 (1449 bp) | 81 (482 AA) |
| Plasmid pZKUM | 82 (4313 bp) | — |
| Plasmid pZKL3-9DPN9N | 83 (13565 bp) | — |
| Plasmid pY187 | 84 (9632 bp) | — |
| Plasmid pZK16-ML8N | 85 (15262 bp) | — |
| Plasmid pZK16-MyL8N | 86 (15181 bp) | — |
| Synthetic mutant delta-8 desaturase ("EgD8M"), derived from *Euglena gracilis* ("EgD8S") | 87 (1272 bp) | 88 (422 AA) |
| Plasmid pZK16-ML3 | 89 (15105 bp) | — |
| Synthetic $C_{16/18}$ elongase derived from *Mortierella alpine* ELO3, codon-optimized for expression in *Yarrowia lipolytica* ("ME3S") | 90 (828 bp) | 91 (275 AA) |
| Plasmid pZKMP-ML9DP | 92 (13237 bp) | — |
| *Yarrowia lipolytica* ALK2LM1 promoter region plus N-terminal 66 bp CDS | 93 (899 bp) | — |
| *Yarrowia lipolytica* DGAT2M promoter region | 94 (722 bp) | — |
| Plasmid pZKMP-ML9DCB | 95 (13320 bp) | — |
| Plasmid pZKSL-5S5A5 | 96 (13975 bp) | — |
| Plasmid pZP2-85m98F | 97 (14619 bp) | — |
| 993 bp stuffer fragment | 98 (993 bp) | — |
| Plasmid pYPS234 | 99 (7338 bp) | — |
| 1019 bp stuffer fragment | 100 (1019 bp) | — |
| Plasmid pYPS233 | 101 (7364 bp) | — |

TABLE 1-continued

Summary of Gene and Protein SEQ ID Numbers

| Description | Nucleic acid SEQ ID NO. | Protein SEQ ID NO. |
|---|---|---|
| Plasmid pYSP241 | 102 (9211 bp) | — |
| Synthetic delta-8 desaturase, derived from *Euglena anabaena* UTEX 373, codon-optimized for expression in *Yarrowia lipolytica* ("EaD8S") | 103 (1260 bp) | 104 (420 AA) |
| Synthetic mutant delta-5 desaturase, derived from *Euglena gracilis*, codon-optimized for expression in *Yarrowia lipolytica* ("EgD5M" or "EgD5R*-34g158g") (i.e., comprising HgGG and HDAgH motifs) | 105 (1350 bp) | 106 (449 AA) |
| Synthetic mutant delta-5 desaturase, derived from *Euglena gracilis*, codon-optimized for expression in *Yarrowia lipolytica* ("EgD5M1" or "EgD5R*-34g158g347s") (i.e., comprising HgGG and HDAgH motifs, and a Ser residue at amino acid position 347) | 107 (1350 bp) | 108 (449 AA) |
| Synthetic mutant delta-5 desaturase, derived from *Euglena gracilis* ("EgD5S-36s157g") (i.e., comprising HPGs and HDgSH motifs) | 109 (1350 bp) | 110 (449 AA) |
| Synthetic mutant delta-5 desaturase, derived from *Euglena anabaena* UTEX 373 ("EaD5S-35a158g") (i.e., comprising HaGG and HDgSH motifs) | 111 (1365 bp) | 112 (454 AA) |
| Plasmid pZR5AU-555 | 113 (13926 bp) | — |
| Plasmid pZR5AU-555M | 114 (13926 bp) | — |
| Plasmid pZUFmEgD9ES | 115 (7769 bp) | — |
| Primer pZUFm_6980_012208f | 116 | — |
| Primer pZUFm_40_012208r | 117 | — |
| Synthetic mutant delta-9 elongase, derived from *Euglena gracilis* ("EgD9eS-L35F") | 118 (777 bp) | 119 (258 AA) |
| Plasmid pZuFmEgD9ES-L35F | 120 (7769 bp) | — |
| Synthetic mutant delta-9 elongase, derived from *Euglena gracilis* ("EgD9eS-K58R/I257T") | 121 (777 bp) | 122 (258 AA) |
| Plasmid pZuFmEgD9ES-K58R/I257T | 123 (7769 bp) | — |
| Synthetic mutant delta-9 elongase, derived from *Euglena gracilis* ("EgD9eS-L130M/V243A$_1$") | 124 (777 bp) | 125 (258 AA) |
| Plasmid pZuFmEgD9ES-L130M/V243A$_1$ | 126 | — |
| Synthetic mutant delta-9 elongase, derived from *Euglena gracilis* ("EgD9eS-D98G") | 127 (777 bp) | 128 (258 AA) |
| Plasmid pZuFmEgD9ES-D98G | 129 (7769 bp) | — |
| Synthetic mutant delta-9 elongase, derived from *Euglena gracilis* ("EgD9eS-L130M/V243A$_2$") | 130 (777 bp) | 131 (258 AA) |
| Plasmid pZuFmEgD9ES-L130M/V243A$_2$ | 132 (7769 bp) | — |
| *Ciona intestinalis* elongase (GenBank Accession No. AAV67802 | — | 133 (289 AA) |
| *Oncorhynchus mykiss* elongase (GenBank Accession No. AAV67803 | — | 134 (295 AA) |
| *Marchantia polymorpha* elongase (GenBank | — | 135 |

TABLE 1-continued

Summary of Gene and Protein SEQ ID Numbers

| Description | Nucleic acid SEQ ID NO. | Protein SEQ ID NO. |
|---|---|---|
| Accession No. AAT85662 | — | (290 AA) |
| *Physcomitrella patens* elongase (GenBank Accession No. AAL84174 | — | 136 (290 AA) |
| *Marchantia polymorpha* elongase (GenBank Accession No. BAE71130 | — | 137 (348 AA) |
| *Ostreococcus tauri* elongase (GenBank Accession No. AAV67797) | — | 138 (292 AA) |
| *Pavlova* sp. CCMP459 elongase (GenBank Accession No. AAV33630) | — | 139 (277 AA) |
| *Pavlova salina* elongase (GenBank Accession No. AAY15135) (synonym: Rebecca salina) | — | 140 (302 AA) |
| *Ostreococcus tauri* elongase (GenBank Accession No. AAV67798) | — | 141 (300 AA) |
| *Thalassiosira pseudonana* elongase (GenBank Accession No. AAV67800) | — | 142 (358 AA) |
| *Thalassiosira pseudonana* elongase (GenBank Accession No. AAV67799) | — | 143 (272 AA) |
| *Mortierella alpina* elongase (GenBank Accession No. AAF70417) | — | 144 (318 AA) |
| *Thraustochytrium* sp. FJN-10 elongase (GenBank Accession No. ABC18314) | — | 145 (271 AA) |
| Primer EgD9E_102_053008f | 146 | — |
| Primer EgD9E_760_053008r | 147 | — |
| Plasmid pZuFmEgD9ES-L35G | 148 (7769 bp) | — |
| Synthetic mutant delta-9 elongase, derived from *Euglena gracilis* ("EgD9eS-L35M/Q107E") | 149 (777 bp) | 150 (258 AA) |
| Plasmid pZuFmEgD9ES-L35M/Q107E | 151 (7769 bp) | — |
| Synthetic mutant delta-9 elongase, derived from *Euglena gracilis* ("EgD9eS-L35G") | 152 (777 bp) | — |
| Synthetic mutant delta-9 elongase, derived from *Euglena gracilis* ("EgD9eS-L35G") | 153 (777 bp) | — |
| Synthetic mutant delta-9 elongase, derived from *Euglena gracilis* ("EgD9eS-L35G") | 154 (777 bp) | — |
| oligonucleotide primer pairs utilized to mutate EgD9eS-L35G by site directed mutagenesis | 155-176 | — |
| Synthetic mutant delta-9 elongase, derived from *Euglena gracilis* ("EgD9eS-A21V/L35G/L108G/I179R") | 177 (777 bp) | 178 (258 AA) |
| Plasmid pZuFmEgD9ES-A21V/L35G/L108G/I179R | 179 (7769 bp) | — |
| HxGx motif | — | 180 |
| HPGG motif | — | 181 |
| HxxxH motif | — | 182 |
| HDASH motif | — | 183 |
| *Euglena gracilis* delta-5 desaturase ("EgD5") | 184 (1350 bp) | 185 (449 AA) |

TABLE 1-continued

Summary of Gene and Protein SEQ ID Numbers

| Description | Nucleic acid SEQ ID NO. | Protein SEQ ID NO. |
|---|---|---|
| His-rich motif: H(X)$_3$H | — | 186 |
| His-rich motif: H(X)$_4$H | — | 187 |
| His-rich motif: H(X)$_2$HH | — | 188 |
| His-rich motif: H(X)$_3$HH | — | 189 |
| His-rich motif: (H/Q)(X)$_2$HH | — | 190 |
| His-rich motif: (H/Q)(X)$_3$HH | — | 191 |
| Variant *Euglena gracilis* delta-5 desaturase, comprising an Arg at amino acid position 347 ("EgD5R") | 192 (1350 bp) | 193 (449 AA) |
| Plasmid pDMW367 | 194 (8438 bp) | — |
| Synthetic delta-5 desaturase, derived from *Euglena gracilis*, codon-optimized for expression in *Yarrowia lipolytica* ("EgD5S") | 195 (1350 bp) | 196 (449 AA) |
| Modified variant *Euglena gracilis* delta-5 desaturase comprising an Arg at amino acid position 347, with four coding region restriction enzyme sites removed ("EgD5R*") | 197 (1350 bp) | 198 (449 AA) |
| Plasmid pDMW367-M4 | 199 (8438 bp) | — |
| Oligonucleotide primer pairs utilized to mutate the native EcoRI and Bg/II restriction enzyme sites of the EgD5R coding region and generate pDMW367-M4 | 200-203 | — |
| Plasmid pDMW367-M2 | 204 (8438 bp) | — |
| Oligonucleotide primer pairs utilized to mutate the native HindIII and NcoI restriction enzyme sites of the EgD5R coding region and generate pDMW367-M4 | 205-208 | — |
| Oligonucleotide primers utilized to individually mutate the Ala residue of the HDASH motif of EgD5R* by site-directed mutagenesis | 209-246 | — |
| Synthetic mutant delta-5 desaturase, derived from *Euglena gracilis* ("EgD5R*-157g") (i.e., comprising a HDgSH motif) | — | 247 (449 AA) |
| Synthetic mutant delta-5 desaturase, derived from *Euglena gracilis* ("EgD5R*-157s") (i.e., comprising a HDsSH motif) | — | 248 (449 AA) |
| Oligonucleotide primers utilized to individually mutate the Ser residue of the HDASH motif of EgD5R* by site-directed mutagenesis | 249-286 | — |
| Synthetic mutant delta-5 desaturase, derived from *Euglena gracilis* ("EgD5R*-158a") (i.e., comprising a HDAaH motif) | — | 287 (449 AA) |
| Synthetic mutant delta-5 desaturase, derived from *Euglena gracilis* ("EgD5R*-158g") (i.e., comprising a HDAgH motif) | — | 288 (449 AA) |
| Plasmid pDMW367M4-157g | 289 (8438 bp) | — |
| Plasmid pDMW367M4-158a | 290 (8438 bp) | — |
| Plasmid pDMW367M4-158g | 291 (8438 bp) | — |

TABLE 1-continued

Summary of Gene and Protein SEQ ID Numbers

| Description | Nucleic acid SEQ ID NO. | Protein SEQ ID NO. |
|---|---|---|
| Oligonucleotide primers utilized to individually mutate either the Pro residue or the second Gly residue of the HPGG motif of EgD5R*-157g, EgD5R*-158a and EgD5R*-158g by site-directed mutagenesis | 292-297 | — |
| Synthetic mutant delta-5 desaturase, derived from *Euglena gracilis* ("EgD5R*-34g157g") (i.e., comprising HgGG and HDgSH motifs) | 298 (1350 bp) | 299 (449 AA) |
| Synthetic mutant delta-5 desaturase, derived from *Euglena gracilis* ("EgD5R*-34g158a") (i.e., comprising HgGG and HDAaH motifs) | 300 (1350 bp) | 301 (449 AA) |
| Synthetic mutant delta-5 desaturase, derived from *Euglena gracilis* ("EgD5R*-34g158g") (i.e., comprising HgGG and HDAgH motifs) | 302 (1350 bp) | 303 (449 AA) |
| Plasmid pEgD5M | 304 (4070 bp) | — |
| Plasmid pDMW367-5M, comprising EgD5M | 305 (8438 bp) | — |
| Plasmid pEgD5M1 | 306 (4070 bp) | — |
| Plasmid pDMW367-5M1, comprising EgD5M1 | 307 (8438 bp) | — |
| Synthetic mutant delta-5 desaturase, derived from *Euglena gracilis* and codon optimized for expression in *Yarrowia lipolytica* ("EgD5S-36s") (i.e., comprising a HPGs motif) | — | 308 (449 AA) |
| Plasmid pDMW369S | 309 (8438 bp) | — |
| Oligonucleotide primers utilized to individually mutate the Asp, Ala, or Ser residue of the HDASH motif of EgD5S-36s by site-directed mutagenesis | 310-327 | — |
| Synthetic mutant delta-5 desaturase, derived from *Euglena gracilis* and codon optimized for expression in *Yarrowia lipolytica* ("EgD5S-36s156e") (i.e., comprising HPGs and HeASH motifs) | 328 (1350 bp) | 329 (449 AA) |
| Synthetic mutant delta-5 desaturase, derived from *Euglena gracilis* and codon optimized for expression in *Yarrowia lipolytica* ("EgD5S-36s158a") (i.e., comprising HPGs and HDAaH motifs) | 330 (1350 bp) | 331 (449 AA) |
| Synthetic mutant delta-5 desaturase, derived from *Euglena gracilis* and codon optimized for expression in *Yarrowia lipolytica* ("EgD5S-36s158g") (i.e., comprising HPGs and HDAgH motifs) | 332 (1350 bp) | 333 (449 AA) |
| Synthetic mutant delta-5 desaturase, derived from *Euglena anabaena* and codon optimized for expression in *Yarrowia lipolytica* ("EaD5S-35a") (i.e., comprising a HaGG motif) | — | 334 (454 AA) |
| *Euglena anabaena* UTEX 373 delta-5 desaturase ("EaD5") | 335 (1362 bp) | 336 (454 AA) |
| Synthetic delta-5 desaturase, derived from *Euglena anabaena* UTEX 373, codon-optimized for expression in *Yarrowia lipolytica* ("EaD5S") | 337 (1362 bp) | 338 (454 AA) |
| Plasmid pZuFmEaD5S-A(S) | 339 (8357 bp) | — |
| Oligonucleotide primers utilized to individually mutate the Asp, Ala or Ser residue of the HDASH motif of EgD5S-35a by site-directed mutagenesis | 340-361 | — |

TABLE 1-continued

Summary of Gene and Protein SEQ ID Numbers

| Description | Nucleic acid SEQ ID NO. | Protein SEQ ID NO. |
|---|---|---|
| Synthetic mutant delta-5 desaturase, derived from *Euglena anabaena* and codon optimized for expression in *Yarrowia lipolytica* ("EaD5S-35a158s") (i.e., comprising HaGG and HDsSH motifs) | 362 (1365 bp) | 363 (454 AA) |
| Synthetic mutant delta-5 desaturase, derived from *Euglena anabaena* and codon optimized for expression in *Yarrowia lipolytica* ("EaD5S-35a159g) (i.e., comprising HaGG and HDAgH motifs) | 364 (1365 bp) | 365 (454 AA) |
| Primer FBAIN-F | 366 | — |
| Primer Y1026 | 367 | — |
| Synthetic mutant delta-9 elongase, derived from *Euglena gracilis* ("EgD9eS-L35G/W132T/I179R") | 368 (777 bp) | 369 (258 AA) |
| Plasmid pZuFmEgD9ES-L35G/W132T/I179R | 370 (7769 bp) | — |
| Synthetic mutant delta-9 elongase, derived from *Euglena gracilis* ("EgD9eS-S9D/L35G/Y84C/I179R") | 371 (777 bp) | 372 (258 AA) |
| Plasmid pZuFmEgD9ES-S9D/L35G/Y84C/I179R | 373 (7769 bp) | — |
| Synthetic mutant delta-9 elongase, derived from *Euglena gracilis* ("EgD9eS-L35G/Y84C/I179R/Q244N") | 374 (777 bp) | 375 (258 AA) |
| Plasmid pZuFmEgD9ES-L35G/Y84C/I179R/Q244N | 376 (7769 bp) | — |
| Synthetic mutant delta-9 elongase, derived from *Euglena gracilis* ("EgD9eS-A21V/L35G/W132T/I179R/Q244N") | 377 (777 bp) | 378 (258 AA) |
| Plasmid pZuFmEgD9ES-A21V/L35G/W132T/I179R/Q244N | 379 (7769 bp) | — |
| HDgnH motif | — | 380 |
| HDAnH motif | — | 381 |
| HefaH motif | — | 382 |
| HeftH motif | — | 383 |
| HemgH motif | — | 384 |
| HeAgH motif | — | 385 |
| HDfgH motif | — | 386 |
| HDygH motif | — | 387 |
| HDscH motif | — | 388 |
| HDAcH motif | — | 389 |
| HDcSH motif | — | 390 |
| HDdSH motif | — | 391 |
| HDeSH motif | — | 392 |
| HDfSH motif | — | 393 |
| HDhSH motif | — | 394 |
| HDiSH motif | — | 395 |
| HDkSH motif | — | 396 |

TABLE 1-continued

Summary of Gene and Protein SEQ ID Numbers

| Description | Nucleic acid SEQ ID NO. | Protein SEQ ID NO. |
|---|---|---|
| HDlSH motif | — | 397 |
| HDmSH motif | — | 398 |
| HDnSH motif | — | 399 |
| HDpSH motif | — | 400 |
| HDqSH motif | — | 401 |
| HDrSH motif | — | 402 |
| HDtSH motif | — | 403 |
| HDvSH motif | — | 404 |
| HDwSH motif | — | 405 |
| HDySH motif | — | 406 |
| HDAcH motif | — | 407 |
| HDAdH motif | — | 408 |
| HDAeH motif | — | 409 |
| HDAfH motif | — | 410 |
| HDAhH motif | — | 411 |
| HDAiH motif | — | 412 |
| HDAkH motif | — | 413 |
| HDAlH motif | — | 414 |
| HDAmH motif | — | 415 |
| HDAnH motif | — | 416 |
| HDApH motif | — | 417 |
| HDAqH motif | — | 418 |
| HDArH motif | — | 419 |
| HDAtH motif | — | 420 |
| HDAvH motif | — | 421 |
| HDAwH motif | — | 422 |
| HDAyH motif | — | 423 |
| HDxxH motif | — | 424 |
| HgGG motif | — | 425 |
| HhGG motif | — | 426 |
| HPGs motif | — | 427 |
| HaGG motif | — | 428 |
| HDgSH motif | — | 429 |
| HDsSH motif | — | 430 |
| HDAaH motif | — | 431 |
| HDAgH motif | — | 432 |
| HeASH motif | — | 433 |

TABLE 1-continued

Summary of Gene and Protein SEQ ID Numbers

| Description | Nucleic acid SEQ ID NO. | Protein SEQ ID NO. |
|---|---|---|
| HDxSH motif | — | 434 |
| HDAxH motif | — | 435 |
| HPGx motif | — | 436 |
| HxGG motif | — | 437 |

DETAILED DESCRIPTION OF THE INVENTION

All patents, patent applications, and publications cited herein are incorporated by reference in their entirety.

In this disclosure, a number of terms and abbreviations are used. Standard three-letter codes or single-letter codes are used to refer to amino acids. The following definitions are provided.

"Open reading frame" is abbreviated as "ORF".

"Polymerase chain reaction" is abbreviated as "PCR".

"American Type Culture Collection" is abbreviated as "ATCC".

"Polyunsaturated fatty acid(s)" is abbreviated as "PUFA(s)".

"Triacylglycerols" are abbreviated as "TAGs".

"Co-enzyme A" is abbreviated as "CoA".

"Total fatty acids" are abbreviated as "TFAs".

"Fatty acid methyl esters" are abbreviated as "FAMEs".

"Dry cell weight" is abbreviated as "DCW".

"Weight percent" is abbreviated as "wt %".

As used herein the term "invention" or "present invention" is intended to refer to all aspects and embodiments of the invention as described in the claims and specification herein and should not be read so as to be limited to any particular embodiment or aspect.

The terms "food product", "pharmaceutical", "infant formula", "dietary supplement", "animal feed" and "aquaculture feed" are as defined in U.S. Pat. Appl. Pub. No. 2010-0317072-A1.

As used herein the term "biomass" refers specifically to spent or used cellular material from the fermentation of a recombinant production host producing EPA in commercially significant amounts. The preferred production host is a recombinant strain of oleaginous yeast, preferably of the genus *Yarrowia* and more preferably *Yarrowia lipolytica*. Biomass may be in the form of whole cells, whole cell lysates, homogenized cells, partially hydrolyzed cellular material, and/or partially purified cellular material (e.g., microbially produced oil).

The term "'lipids" refer to any fat-soluble (i.e., lipophilic), naturally-occurring molecule. A general overview of lipids is provided in U.S. Pat. Appl. Pub. No. 2009-0093543-A1 (see Table 2 therein).

The term "oil" refers to a lipid substance that is liquid at 25° C.; the oil and is hydrophobic but is soluble in organic solvents. In oleaginous organisms, oil constitutes a major part of the total lipid. "Oil" is composed primarily of triacylglycerols ["TAGs"] but may also contain other neutral lipids, phospholipids and free fatty acids. The fatty acid composition in the oil and the fatty acid composition of the total lipid are generally similar; thus, an increase or decrease in the concentration of fatty acids in the total lipid will correspond with an increase or decrease in the concentration of fatty acids in the oil, and vice versa.

"Neutral lipids" refer to those lipids commonly found in cells in lipid bodies as storage fats and are so called because at cellular pH, the lipids bear no charged groups. Generally, they are completely non-polar with no affinity for water. Neutral lipids generally refer to mono-, di-, and/or triesters of glycerol with fatty acids, also called monoacylglycerol, diacylglycerol or triacylglycerol, respectively, or collectively, acylglycerols. A hydrolysis reaction must occur to release free fatty acids from acylglycerols.

The term "triacylglycerols" ["TAGs"] refers to neutral lipids composed of three fatty acyl residues esterified to a glycerol molecule. TAGs can contain long chain PUFAs and saturated fatty acids, as well as shorter chain saturated and unsaturated fatty acids.

The term "total fatty acids" ["TFAs"] herein refer to the sum of all cellular fatty acids that can be derivitized to fatty acid methyl esters ["FAMEs"] by the base transesterification method (as known in the art) in a given sample, which may be the biomass or oil, for example. Thus, total fatty acids include fatty acids from neutral lipid fractions (including diacylglycerols, monoacylglycerols and TAGs) and from polar lipid fractions (including, e.g., the phosphatidylcholine and the phosphatidylethanolamine fractions) but not free fatty acids.

The term "total lipid content" of cells is a measure of TFAs as a percent of the dry cell weight ["DCW"], although total lipid content can be approximated as a measure of FAMEs as a percent of the DCW ["FAMEs % DCW"]. Thus, total lipid content ["TFAs % DOW"] is equivalent to, e.g., milligrams of total fatty acids per 100 milligrams of DCW.

The concentration of a fatty acid in the total lipid is expressed herein as a weight percent of TFAs ["% TFAs"], e.g., milligrams of the given fatty acid per 100 milligrams of TFAs. Unless otherwise specifically stated in the disclosure herein, reference to the percent of a given fatty acid with respect to total lipids is equivalent to concentration of the fatty acid as % TFAs (e.g., % EPA of total lipids is equivalent to EPA % TFAs).

In some cases, it is useful to express the content of a given fatty acid(s) in a cell as its weight percent of the dry cell weight ["% DCW"]. Thus, for example, a measure of EPA productivity ["EPA % DOW"] would be determined according to the following formula: (EPA % TFAs)*(TFAs % DCW)]/100. The content of a given fatty acid(s) in a cell as its weight percent of the dry cell weight ["% DOW"] can be approximated, however, as: (EPA % TFAs)*(FAMEs % DCW)]/100.

The terms "lipid profile" and "lipid composition" are interchangeable and refer to the amount of individual fatty acids contained in a particular lipid fraction, such as in the total lipid or the oil, wherein the amount is expressed as a wt % of TFAs. The sum of each individual fatty acid present in the mixture should be 100.

The term "extracted oil" refers to an oil that has been separated from other cellular materials, such as the microorganism in which the oil was synthesized. Extracted oils are obtained through a wide variety of methods, the simplest of which involves physical means alone. For example, mechanical crushing using various press configurations (e.g., screw, expeller, piston, bead beaters, etc.) can separate oil from cellular materials. Alternately, oil extraction can occur via treatment with various organic solvents (e.g., hexane), via enzymatic extraction, via osmotic shock, via ultrasonic extraction, via supercritical fluid extraction (e.g., $CO_2$ extraction), via saponification and via combinations of these methods. An extracted oil may be purified or further concentrated. The extracted oils described herein will comprise at least 45 EPA % TFAs.

The term "blended oil" refers to an oil that is obtained by admixing, or blending, the extracted oil described herein with any combination of, or individual, oil to obtain a desired composition. Thus, for example, types of oils from different microbes can be mixed together to obtain a desired PUFA composition. Alternatively, or additionally, the PUFA-containing oils disclosed herein can be blended with fish oil, vegetable oil or a mixture of both to obtain a desired composition.

The term "fatty acids" refers to long chain aliphatic acids (alkanoic acids) of varying chain lengths, from about $C_{12}$ to $C_{22}$, although both longer and shorter chain-length acids are known. The predominant chain lengths are between $C_{16}$ and $C_{22}$. The structure of a fatty acid is represented by a simple notation system of "X:Y", where X is the total number of carbon ["C"] atoms in the particular fatty acid and Y is the number of double bonds. Additional details concerning the differentiation between "saturated fatty acids" versus "unsaturated fatty acids", "monounsaturated fatty acids" versus "polyunsaturated fatty acids" ["PUFAs"], and "omega-6 fatty acids" ["Ω-6" or "n-6"] versus "omega-3 fatty acids" ["Ω-3" or "n-3"] are provided in U.S. Pat. No. 7,238,482, which is hereby incorporated herein by reference.

Nomenclature used to describe PUFAs herein is given in Table 2. In the column titled "Shorthand Notation", the omega-reference system is used to indicate the number of carbons, the number of double bonds and the position of the double bond closest to the omega carbon, counting from the omega carbon, which is numbered 1 for this purpose. The remainder of the Table summarizes the common names of omega-3 and omega-6 fatty acids and their precursors, the abbreviations that will be used throughout the specification and the chemical name of each compound.

TABLE 2

Nomenclature of Polyunsaturated Fatty Acids And Precursors

| Common Name | Abbreviation | Chemical Name | Shorthand Notation |
|---|---|---|---|
| Myristic | — | tetradecanoic | 14:0 |
| Palmitic | Palmitate | hexadecanoic | 16:0 |
| Palmitoleic | — | 9-hexadecenoic | 16:1 |
| Stearic | — | octadecanoic | 18:0 |
| Oleic | — | cis-9-octadecenoic | 18:1 |
| Linoleic | LA | cis-9,12-octadecadienoic | 18:2 ω – 6 |
| γ-Linolenic | GLA | cis-6,9,12-octadecatrienoic | 18:3 ω – 6 |
| Eicosadienoic | EDA | cis-11,14-eicosadienoic | 20:2 ω – 6 |
| Dihomo-γ-Linolenic | DGLA | cis-8,11,14-eicosatrienoic | 20:3 ω – 6 |

TABLE 2-continued

Nomenclature of Polyunsaturated Fatty Acids And Precursors

| Common Name | Abbreviation | Chemical Name | Shorthand Notation |
|---|---|---|---|
| Arachidonic | ARA | cis-5,8,11,14-eicosatetraenoic | 20:4 ω – 6 |
| α-Linolenic | ALA | cis-9,12,15-octadecatrienoic | 18:3 ω – 3 |
| Stearidonic | STA | cis-6,9,12,15-octadecatetraenoic | 18:4 ω – 3 |
| Eicosatrienoic | ETrA | cis-11,14,17-eicosatrienoic | 20:3 ω – 3 |
| Eicosatetraenoic | ETA | cis-8,11,14,17-eicosatetraenoic | 20:4 ω – 3 |
| Eicosapentaenoic | EPA | cis-5,8,11,14,17-eicosapentaenoic | 20:5 ω – 3 |
| Docosatetraenoic | DTA | cis-7,10,13,16-docosatetraenoic | 22:4 ω – 6 |
| Docosapentaenoic | DPAn-6 | cis-4,7,10,13,16-docosapentaenoic | 22:5 ω – 6 |
| Docosapentaenoic | DPA | cis-7,10,13,16,19-docosapentaenoic | 22:5 ω – 3 |
| Docosahexaenoic | DHA | cis-4,7,10,13,16,19-docosahexaenoic | 22:6 ω – 3 |

The term "PUFA biosynthetic pathway" refers to a metabolic process that converts oleic acid to omega-6 fatty acids such as LA, EDA, GLA, DGLA, ARA, DTA and DPAn-6 and omega-3 fatty acids such as ALA, STA, ETrA, ETA, EPA, DPA and DHA. This process is well described in the literature (e.g., see U.S. Pat. No. 7,932,077 and U.S. Pat. Appl. Pub. No. 2009-0093543-A1). Briefly, this process involves elongation of the carbon chain through the addition of carbon atoms and desaturation of the molecule through the addition of double bonds, via a series of special elongation and desaturation enzymes termed "PUFA biosynthetic pathway enzymes" that are present in the endoplasmic reticulum membrane. More specifically, "PUFA biosynthetic pathway enzymes" refer to any of the following enzymes (and genes which encode said enzymes) associated with the biosynthesis of a PUFA, including: delta-4 desaturase, delta-5 desaturase, delta-6 desaturase, delta-12 desaturase, delta-15 desaturase, delta-17 desaturase, delta-9 desaturase, delta-8 desaturase, delta-9 elongase, $C_{14/16}$ elongase, $C_{16/18}$ elongase, $C_{18/20}$ elongase and/or $C_{20/22}$ elongase.

The term "delta-9 elongase/delta-8 desaturase pathway" will refer to a PUFA biosynthetic pathway that includes at least one delta-9 elongase and at least one delta-8 desaturase, thereby enabling biosynthesis of DGLA and/or ETA from LA and ALA, respectively, with EDA and/or ETrA as intermediate fatty acids. With expression of other desaturases and elongases, ARA, DTA, DPAn-6, EPA, DPA and DHA may also be synthesized.

The terms "conversion efficiency" and "percent substrate conversion" refer to the efficiency by which a particular enzyme, such as a desaturase, elongase or multizyme, can convert substrate to product. The conversion efficiency is measured according to the following formula: ([product]/[substrate+product])*100, where 'product' includes the immediate product and all products in the pathway derived from it.

The term "desaturase" refers to a polypeptide that can desaturate, i.e., introduce a double bond, in one or more fatty acids to produce a fatty acid or precursor of interest. Despite use of the omega-reference system throughout the specification to refer to specific fatty acids, it is more convenient to indicate the activity of a desaturase by counting from the carboxyl end of the substrate using the delta-system. Of particular interest herein are: delta-8 desaturases, delta-5 desaturases, delta-17 desaturases and delta-12 desaturases. Other useful desaturases can include delta-4 desaturases, delta-6 desaturases, delta-15 desaturases and delta-9 desaturases.

The term "elongase" refers to a polypeptide that can elongate a fatty acid carbon chain to produce an acid 2 carbons longer than the fatty acid substrate that the elongase acts upon. This process of elongation occurs in a multi-step mechanism in association with fatty acid synthase, as described in U.S. Pat. No. 7,659,120. Examples of reactions catalyzed by elongase systems are the conversion of GLA to DGLA, STA to ETA, ARA to DTA and EPA to DPA. In general, the substrate selectivity of elongases is somewhat broad but segregated by both chain length and the degree and type of unsaturation. For example, a $C_{14/16}$ elongase will utilize a $C_{14}$ substrate (e.g., myristic acid), a $C_{16/18}$ elongase will utilize a $C_{16}$ substrate (e.g., palmitate), a $C_{18/20}$ elongase will utilize a $C_{18}$ substrate (e.g., GLA, STA) and a $C_{20/22}$ elongase [also referred to as a delta-5 elongase or C20 elongase] will utilize a $C_{20}$ substrate (e.g., ARA, EPA). For the purposes herein, two distinct types of $C_{18/20}$ elongases can be defined: a delta-6 elongase will catalyze conversion of GLA and STA to DGLA and ETA, respectively, while a delta-9 elongase is able to catalyze the conversion of LA and ALA to EDA and ETrA, respectively.

"$C_{18}$ to $C_{20}$ elongation conversion efficiency" refers to the efficiency by which $C_{18/20}$ elongases can convert $C_{18}$ substrates (i.e., LA, ALA, GLA, STA) to $C_{20}$ products (i.e., EDA, ETrA, DGLA, ETA). These $C_{18/20}$ elongases can be either delta-9 elongases or delta-6 elongases.

The term "delta-9 elongation conversion efficiency" refers to the efficiency by which delta-9 elongase can convert $C_{18}$ substrates (i.e., LA, ALA) to $C_{20}$ products (i.e., EDA, ETrA).

The term "EgD9e" refers to a delta-9 elongase (SEQ ID NO:32) isolated from *Euglena gracilis*, encoded by SEQ ID NO:31 herein. Similarly, the term "EgD9eS" refers to a synthetic delta-9 elongase derived from *E. gracilis* that is codon-optimized for expression in *Yarrowia lipolytica* (i.e., SEQ ID NOs:2 and 3). Further details concerning EgD9e and EgD9eS, as well as delta-9 elongase motifs, are described in U.S. Pat. No. 7,645,604.

The term "EaD9e" refers to a delta-9 elongase (SEQ ID NO:34) isolated from *Euglena anabaena*, encoded by SEQ ID NO:33 herein. Similarly, the term "EaD9eS" refers to a synthetic delta-9 elongase derived from *E. anabaena* that is codon-optimized for expression in *Yarrowia lipolytica* (i.e., SEQ ID NOs:35 and 36). Further details concerning EaD9e and EaD9eS are described in U.S. Pat. No. 7,794,701.

The term "E389D9e" refers to a delta-9 elongase (SEQ ID NO:38) isolated from *Eutreptiella* sp. CCMP389, encoded by SEQ ID NO:37 herein. Similarly, the term "E389S9eS" refers to a synthetic delta-9 elongase derived from *Eutreptiella* sp. CCMP389 that is codon-optimized for expression in *Yarrowia lipolytica* (i.e., SEQ ID NOs:39 and 40). Further details concerning E389D9e and E389D9eS are described in U.S. Pat. No. 7,645,604.

The term "IgD9e" refers to a delta-9 elongase (SEQ ID NO:42; NCBI Accession No. AAL37626 (GI 17226123)) isolated from *Isochrysis galbana*, encoded by SEQ ID NO:41 herein.

The term "mutant delta-9 elongase" or "mutant EgD9eS" refers to a delta-9 elongase that has at least one mutation with respect to the synthetic delta-9 elongase derived from *Euglena gracilis* that is codon-optimized for expression in *Yarrowia lipolytica* (i.e., EgD9eS [SEQ ID NOs:2 and 3]). Although "mutations" may include any deletions, insertions and point mutations (or combinations thereof), in preferred embodiments the mutant EgD9eS is set forth in SEQ ID NO:1 (FIG. 16B), wherein SEQ ID NO:1 differs from SEQ ID NO:3 by at least one amino acid mutation, said mutation(s) selected from the group consisting of: a) a L35F mutation; b) a L35M mutation; c) a L35G mutation; d) a L35G mutation and at least one other mutation selected from the group consisting of: S9A, S9D, S9G, S9I, S9K, S9Q, Q12K, A21D, A21T, A21V, V32F, Y84C, Q107E, L108G, G127L, W132T, M143N, M143W, L161T, L161Y, W168G, I179M, I179R, C236N, Q244N, A254W and A254Y; e) L35G, A21V, L108G and I179R mutations; f) L35G, W132T and I179R mutations; g) L35G, S9D, Y84C and I179R mutations; h) L35G, Y84C, I179R and Q244N mutations; i) L35G, A21V, W132T, I179R and Q244N mutations; j) K58R and I257T mutations; k) a D98G mutation; l) L130M and V243A mutations; and, m) any combination comprising at least two mutations, wherein the mutations are selected from the group consisting of: K58R, L35F, L35G, L35M, S9A, S9D, S9G, S9I, S9K, S9Q, Q12K, A21D, A21T, A21V, V32F, Y84C, D98G, Q107E, L108G, G127L, L130M, W132T, M143N, M143W, L161T, L161Y, W168G, I179M, I179R, C236N, V243A, Q244N, A254W, A254Y and I257T. For each substitution listed, the first letter corresponds to the amino acid in EgD9eS (SEQ ID NO:3) and the second letter corresponds to the amino acid found in the same position in the mutant (SEQ ID NO:1), i.e., L35F indicates a change from Leu [L] in EgD9eS at position 35 to Phe [F] in the EgD9eS mutant. This nomenclature is used throughout the specification to refer to mutations within the delta-9 elongase proteins described herein; similar notation is used to describe substitutions within the nucleotide sequence (i.e., C62T indicates a change from cytosine [C] in EgD9eS (SEQ ID NO:2) at position 62 to thymine [T] in the EgD9eS mutant).

The mutant EgD9eS will have "improved delta-9 elongase activity" to EgD9eS when enzymatic activity is compared, despite differing polypeptide sequences. Thus, a mutant EgD9eS sequence will possess increased enzymatic activity when compared to that of EgD9eS (i.e., at least about 101-110%, preferably at least about 110-125%, more preferably at least about 125-150%, and most preferably greater than about 150% of the enzymatic activity of EgD9eS). Although preferred ranges are described above, useful examples of conversion efficiencies include any integer percentage from 50% to at least 150%, such as 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, 100%, 101%, 102%, 103%, 104%, 105%, 106%, 107%, 108%, 109%, 110%, 111%, 112%, 113%, 114%, 115%, 116%, 117%, 118%, 119%, 120%, 121%, 122%, 123%, 124%, 125%, 126%, 127%, 128%, 129%, 130%, 131%, 132%, 133%, 134%, 135%, 136%, 137%, 138%, 139%, 140%, 141%, 142%, 143%, 144%, 145%, 146%, 147%, 148%, 149% and 150%.

The term "EgD9eS-L35G" refers to a synthetic mutant delta-9 elongase (SEQ ID NO:44) having a single L35G mutation with respect to EgD9eS (SEQ ID NO:3), encoded by SEQ ID NO:43 herein.

The term "multizyme" or "fusion protein" refers to a single polypeptide having at least two independent and separable enzymatic activities, wherein the first enzymatic activity is preferably linked to the second enzymatic activity (U.S. Pat. Appl. Pub. No. 2008-0254191-A1). The "linker" between the at least two independent and separable enzymatic activities may be comprised of a single polypeptide, although the linker may also be comprised of one amino acid residue, such as Pro, or a polypeptide comprising at least one Pro. Preferred linkers are selected from the group consisting of: SEQ ID NO:4, SEQ ID NO:5, SEQ ID NO:6, SEQ ID NO:7, SEQ ID NO:8, SEQ ID NO:9 and SEQ ID NO:10.

The term "DGLA synthase" refers to a multizyme, wherein a delta-9 elongase is linked to a delta-8 desaturase. The term "EgD9eS/EgD8M" refers to a DGLA synthase (SEQ ID NOs:11 and 12) created by linking the delta-9 elongase "EgD9eS" (U.S. Pat. No. 7,645,604) to the delta-8 desaturase "EgD8M" (U.S. Pat. No. 7,709,239) with a linker sequence (i.e., SEQ ID NO:4 [GAGPARPAGLPPATYYD-SLAVMGS]; U.S. Pat. Appl. Pub. No. 2008-0254191-A1). Similarly, the term "EaD9eS/EaD8S" refers to a DGLA synthase (SEQ ID NOs:13 and 14) created by linking the delta-9 elongase "EaD9eS" (U.S. Pat. No. 7,794,701) to the delta-8 desaturase "EaD8S" (U.S. Pat. No. 7,790,156) with the linker sequence set forth as SEQ ID NO:4. And, the term "E389D9eS/EgD8M" refers to a DGLA synthase (SEQ ID NOs:15 and 16) created by linking the delta-9 elongase "E389D9eS" (U.S. Pat. No. 7,645,604) to the delta-8 desaturase "EgD8M" (supra) with the linker sequence set forth as SEQ ID NO:4.

The term "acyltransferase" refers to an enzyme responsible for transferring an acyl group from a donor lipid to an acceptor lipid molecule.

The term "acyl-CoA:lysophospholipid acyltransferase" or "lysophospholipid acyltransferase" ["LPLAT"] refers to a broad class of acyltransferases, having the ability to acylate a variety of lysophospholipid substrates at the sn-2 position. More specifically, LPLATs include lysophosphatidic acid ["LPA"] acyltransferases ["LPAATs"] having the ability to catalyze conversion of LPA to phosphatidic acid ["PA"], lysophosphatidylcholine ["LPC"] acyltransferases ["LPCATs"] having the ability to catalyze conversion of LPC to phosphatidylcholines ["PC"], lysophosphatidylethanolamine ["LPE"] acyltransferases ["LPEATs"] having the ability to catalyze conversion of LPE to phosphatidylethanolamines ["PE"], lysophosphatidylserine ["LPS"] acyltransferases ["LPLATs"] having the ability to catalyze conversion of LPS to phosphatidylserines ["PS"], lysophosphatidylglycerol ["LPG"] acyltransferases ["LPGATs"] having the ability to catalyze conversion of LPG to phosphatidylglycerols ["PG"], and lysophosphatidylinositol ["LPI"] acyltransferases ["LPI-ATs"] having the ability to catalyze conversion of LPI to phosphatidylinositols ["PI"].

The term "polypeptide having at least lysophosphatidic acid acyltransferase ["LPAAT"] activity" will refer to those enzymes capable of catalyzing the reaction: acyl-CoA+1-acyl-sn-glycerol 3-phosphate→CoA+1,2-diacyl-sn-glycerol 3-phosphate (EC 2.3.1.51). Thus, an "LPAAT" refers to a protein as described in U.S. Pat. Appl. Pub. No. 2010-0317072-A1 and U.S. Pat. Appl. Pub. No. 2010-0317882-A1 that: 1) has LPAAT activity and shares at least about 43.9% amino acid identity, based on the Clustal W method of alignment, when compared to an amino acid sequence selected from the group consisting of SEQ ID NO:18 (MaLPAAT1), SEQ ID NO:22 (YILPAAT1) and SEQ ID NO:23 (ScLPAAT1); and/or, 2) has LPAAT activity and has at least one 1-acyl-sn-glycerol-3-phosphate acyltransferase family motif selected from the group consisting of: NHxxxxD (SEQ ID NO:26) and EGTR (SEQ ID NO:27). Examples of LPAAT polypeptides include ScLPAAT, ScLPAATS, MaLPAAT1, MaLPAAT1S and YILPAAT1, infra.

The term "ScLPAAT" refers to a LPAAT (SEQ ID NO:23) isolated from *Saccharomyces cerevisiae* (ORF "YDL052C"). In contrast, the term "ScLPAATS" refers to a synthetic LPAAT derived from *S. cerevisiae* that is codon-optimized for expression in *Yarrowia lipolytica* (i.e., SEQ ID NOs:24 and 25) (U.S. Pat. Appl. Pub. No. 2010-0317882-A1).

The term "MaLPAAT1" refers to a LPAAT (SEQ ID NO:18) isolated from *Mortierella alpina*, encoded by the nucleotide sequence set forth as SEQ ID NO:17. In contrast, the term "MaLPAAT1S" refers to a synthetic LPAAT derived from *M. alpina* that is codon-optimized for expression in *Yarrowia lipolytica* (i.e., SEQ ID NOs:19 and 20) (U.S. Pat. No. 7,879,591).

The term "YILPAAT1" refers to a LPAAT (SEQ ID NO:22) isolated from *Yarrowia lipolytica*, encoded by the nucleotide sequence set forth as SEQ ID NO:21.

The term "polypeptide having at least phospholipid:diacylglycerol acyltransferase ["PDAT"] activity" will refer to those enzymes capable of transferring a fatty acyl-group from the sn-2 position of a phospholipid (e.g., phosphatidylcholine) to the sn-3 position of 1,2-diacylglycerol [E.C.2.3.1.158], thus resulting in a lysophospholipid and TAG. Although both PDATs and diacylglycerol acyltransferases (DAGATs) [E.C. 2.3.1.20] are involved in the terminal step of TAG biosynthesis, only PDAT may synthesize TAGs via an acyl-CoA-independent mechanism. A representative PDAT enzyme, as set forth in SEQ ID NO:30, is encoded by the LRO1 gene in *Saccharomyces cerevisiae* (Dahlqvist et al., *Proc. Natl. Acad. Sci. USA* 97:6487 (2000)).

The term "YIPDAT" refers to a PDAT (SEQ ID NO:29) isolated from *Yarrowia lipolytica*, encoded by the nucleotide sequence set forth as SEQ ID NO:28 (U.S. Pat. No. 7,901,928).

The term "choline phosphate cytidylyltransferase" refers to an enzyme (EC 2.7.7.15) of the phosphatidylcholine ["PC"] biosynthetic pathway that catalyzes the chemical reaction: cytidine triphosphate ["CTP"]+choline phosphate ⇌ diphosphate+cytidine diphosphate-choline ["CDP-choline"]. Thus, this enzyme is a transferase capable of transferring phosphorus-containing nucleotide groups (i.e., nucleotidyltransferases), thus playing a role in glycerophospholipid metabolism.

The term "YIPCT" refers to a cholinephosphate cytidylyltransferase (SEQ ID NO:46) isolated from *Yarrowia lipolytica*, encoded by SEQ ID NO:45.

The term "diacylglycerol cholinephosphotransferase" refers to an enzyme (EC 2.7.8.2) of the phosphatidylcholine ["PC"] biosynthetic pathway that catalyzes the synthesis of phosphatidylcholines from CDP-choline and 1,2-diacylglycerols.

The term "YICPT1" refers to a diacylglycerol cholinephosphotransferase (SEQ ID NO:48) isolated from *Yarrowia lipolytica*, encoded by SEQ ID NO:47. YICPT1 is described in Intl. App. Pub. No. WO 2006/052870 (see also GenBank Accession No. XM_501703 (YALI0C10989g)).

"Malonyl-CoA synthetase" [EC 6.2.1.-] catalyzes the following enzymatic reaction: malonate+ATP+CoA→malonyl-CoA+AMP+pyrophosphate (PPi). The enzyme was first purified from malonate-grown *Pseudomonas fluorescens* (Kim, Y. S, and S. K. Bang, *J. Biol. Chem.*, 260:5098-5104 (1985)), although various *Rhizobia* homologs have since been isolated from bacteroids within legume nodules (see, for example, Kim, Y. S, and H. Z. Chae, *Biochem. J.*, 273:511-516 (1991) and Kim, Y. S, and S. W. Kang, *Biochem. J.*, 297:327-333 (1994)).

The term "MCS" refers to a synthetic gene encoding malonyl-CoA synthetase derived from *Rhizobium leguminosarum* bv. *viciae* 3841 (Gen Bank Accession No. YP_766603) that is codon-optimized for expression in *Yarrowia lipolytica* (i.e., SEQ ID NOs:49 and 50) (U.S. Pat. Appl. Pub. No. 2010-0159558-A1).

The term "peroxisomes" refers to ubiquitous organelles found in all eukaryotic cells. They have a single lipid bilayer membrane that separates their contents from the cytosol and that contains various membrane proteins essential to the functions described below. Peroxisomes selectively import proteins via an "extended shuttle mechanism". More specifically, there are at least 32 known peroxisomal proteins, called peroxins, which participate in the process of importing proteins by means of ATP hydrolysis through the peroxisomal membrane. Once cellular proteins are imported into the peroxisome, they are typically subjected to some means of degradation. For example, peroxisomes contain oxidative enzymes, such as e.g., catalase, D-amino acid oxidase and uric acid oxidase, that enable degradation of substances that are toxic to the cell. Alternatively, peroxisomes breakdown fatty acid molecules to produce free molecules of acetyl-CoA which are exported back to the cytosol, in a process called β-oxidation.

The terms "peroxisome biogenesis factor protein", "peroxin" and "Pex protein" are interchangeable and refer to proteins involved in peroxisome biogenesis and/or that participate in the process of importing cellular proteins by means of ATP hydrolysis through the peroxisomal membrane. The acronym of a gene that encodes any of these proteins is "Pex gene". A system for nomenclature is described by Distel et al., *J. Cell Biol.*, 135:1-3 (1996). At least 32 different Pex genes have been identified so far in various eukaryotic organisms. Based on a review by Kiel, J. A. K. W., et al. (*Traffic*, 7:1291-1303 (2006)), wherein in silico analysis of the genomic sequences of 17 different fungal species was performed, the following Pex proteins were identified: Pex1p, Pex2p, Pex3p, Pex3 Bp, Pex4p, Pex5p, Pex5 Bp, Pex5 Cp, Pex5/20p, Pex6p, Pex7p, Pex8p, Pex10p, Pex12p, Pex13p, Pex14p, Pex15p, Pex16p, Pex17p, Pex14/17p, Pex18p, Pex19p, Pex20p, Pex21p, Pex21Bp, Pex22p, Pex22p-like and Pex26p. Collectively, these proteins will be referred to herein as "Pex proteins", encoded by "Pex genes".

The term "down-regulated" in or in connection with at least one peroxisome biogenesis factor protein refers to reduction in, or abolishment of, the activity of a native Pex protein, as compared to the activity of the wildtype protein. Down-regulation typically occurs when a native Pex gene has a "disruption", referring to an insertion, deletion, or targeted mutation within a portion of that gene, that results in either a complete gene knockout such that the gene is deleted from the genome and no protein is translated or a translated Pex protein having an insertion, deletion, amino acid substitution or other targeted mutation. The down-regulated Pex protein will have impaired activity with respect to the Pex protein that was not down-regulated, and can be non-functional. Down-regulation that results in low or lack of expression of the Pex protein could also result via manipulating the regulatory sequences, transcription and translation factors and/or signal transduction pathways or by use of sense, antisense or RNAi technology, etc.

The term "conserved domain" or "motif" means a set of amino acids conserved at specific positions along an aligned sequence of evolutionarily related proteins. While amino acids at other positions can vary between homologous proteins, amino acids that are highly conserved at specific positions indicate these amino acids may be important in the structure, the stability, or the activity of a protein. Because they are identified by their high degree of conservation in aligned sequences of a family of protein homologues, they can be used as identifiers, or "signatures", to determine if a protein with a newly determined sequence belongs to a previously identified protein family.

The terms "microbial host cell" and "microbial host organism" are used interchangeably herein and refer to a microorganism capable of receiving foreign or heterologous genes and capable of expressing those genes. A "recombinant microbial host cell" refers to a microbial host cell that has been recombinantly engineered.

Generally, the term "oleaginous" refers to those organisms that tend to store their energy source in the form of oil (Weete, In: Fungal Lipid Biochemistry, $2^{nd}$ Ed., Plenum, 1980). During this process, the cellular oil content of oleaginous microorganisms generally follows a sigmoid curve, wherein the concentration of lipid increases until it reaches a maximum at the late logarithmic or early stationary growth phase and then gradually decreases during the late stationary and death phases (Yongmanitchai and Ward, *Appl. Environ. Microbiol.*, 57:419-25 (1991)). For the purposes of the present application, the term "oleaginous" refers to those microorganisms that can accumulate at least about 25% of their dry cell weight ["DCW"] as oil.

The term "oleaginous yeast" refers to those oleaginous microorganisms classified as yeasts that can make oil, i.e., wherein the oil can accumulate in excess of about 25% of their DCW. Examples of oleaginous yeast include, but are no means limited to, the following genera: *Yarrowia*, *Candida*, *Rhodotorula*, *Rhodosporidium*, *Cryptococcus*, *Trichosporon* and *Lipomyces*. The ability to accumulate oil in excess of about 25% of the DCW of the yeast may be through efforts of recombinant engineering or through the natural abilities of the organism.

The term "fermentable carbon source" means a carbon source that a microorganism will metabolize to derive energy. Typical carbon sources include, but are not limited to: monosaccharides, disaccharides, oligosaccharides, polysaccharides, alkanes, fatty acids, esters of fatty acids, glycerol, monoglycerides, diglycerides, triglycerides, carbon dioxide, methanol, formaldehyde, formate and carbon-containing amines.

The terms "polynucleotide", "polynucleotide sequence", "nucleic acid sequence", "nucleic acid fragment" and "isolated nucleic acid fragment" are used interchangeably herein. These terms encompass nucleotide sequences and the like. A polynucleotide may be a polymer of RNA or DNA that is single- or double-stranded, that optionally contains synthetic, non-natural or altered nucleotide bases. A polynucleotide in the form of a polymer of DNA may be comprised of one or more segments of cDNA, genomic DNA, synthetic DNA, or mixtures thereof. Nucleotides (usually found in their 5'-monophosphate form) are referred to by a single letter designation as follows: "A" for adenylate or deoxyadenylate (for RNA or DNA, respectively), "C" for cytidylate or deoxycytidylate, "G" for guanylate or deoxyguanylate, "U" for uridylate, "T" for deoxythymidylate, "R" for purines (A or G), "Y" for pyrimidines (C or T), "K" for G or T, "H" for A or C or T, "I" for inosine, and "N" for any nucleotide.

A "substantial portion" of an amino acid or nucleotide sequence is that portion comprising enough of the amino acid sequence of a polypeptide or the nucleotide sequence of a gene to putatively identify that polypeptide or gene, as described in U.S. Pat. Appl. Pub. No. 2010-0317072-A1, either by manual evaluation of the sequence by one skilled in the art, or by computer-automated sequence comparison and identification using algorithms such as BLAST (Basic Local Alignment Search Tool; Altschul, S. F., et al., *J. Mol. Biol.*, 215:403-410 (1993)).

The term "complementary" is used to describe the relationship between nucleotide bases that are capable of hybridizing to one another. For example, with respect to DNA, adenosine is complementary to thymine and cytosine is complementary to guanine.

"Codon degeneracy" refers to the nature in the genetic code permitting variation of the nucleotide sequence without effecting the amino acid sequence of an encoded polypeptide. The skilled artisan is well aware of the "codon-bias" exhibited by a specific host cell in usage of nucleotide codons to specify a given amino acid. Therefore, when synthesizing a gene for improved expression in a host cell, it is desirable to design the gene such that its frequency of codon usage approaches the frequency of preferred codon usage of the host cell.

"Synthetic genes" are tailored for optimal gene expression based on optimization of nucleotide sequence to reflect the codon bias of the host cell. The skilled artisan appreciates the likelihood of successful gene expression if codon usage is biased towards those codons favored by the host. Determination of preferred codons can be based on a survey of genes derived from the host cell, where sequence information is available. For example, the codon usage profile for *Yarrowia lipolytica* is provided in U.S. Pat. No. 7,125,672.

"Gene" refers to a nucleic acid fragment that expresses a specific protein, and which may refer to the coding region alone or may include regulatory sequences upstream and/or downstream to the coding region (e.g., 5' untranslated regions upstream of the transcription start site of the coding region, 3' non-coding regions). "Native gene" refers to a gene as found in nature with its own regulatory sequences. "Chimeric gene" refers to any gene that is not a native gene, comprising regulatory and coding sequences that are not found together in nature. Accordingly, a chimeric gene may comprise regulatory sequences and coding sequences that are derived from different sources, or regulatory sequences and coding sequences derived from the same source, but arranged in a manner different than that found in nature. "Endogenous gene" refers to a native gene in its natural location in the genome of an organism. A "foreign" gene refers to a gene that is introduced into the host organism by gene transfer. Foreign genes can comprise native genes inserted into a non-native organism, native genes introduced into a new location within the native host, or chimeric genes. A "transgene" is a gene that has been introduced into the genome by a transformation procedure. A "codon-optimized gene" is a gene having its frequency of codon usage designed to mimic the frequency of preferred codon usage of the host cell.

"Coding sequence" refers to a DNA sequence that codes for a specific amino acid sequence. "Regulatory sequences" refer to nucleotide sequences located upstream of the coding sequence's transcription start site, 5' untranslated regions and 3' non-coding regions, and which may influence the transcription, RNA processing or stability, or translation of the associated coding sequence. Regulatory sequences may include promoters, enhancers, silencers, 5' untranslated leader sequence, introns, polyadenylation recognition sequences, RNA processing sites, effector binding sites and stem-loop structures.

"Promoter" refers to a DNA sequence capable of controlling the expression of a coding sequence or functional RNA. In general, a promoter sequence is 5' upstream of a coding sequence. Promoters may be derived in their entirety from a native gene, or be composed of different elements derived from different promoters found in nature, or even comprise synthetic DNA segments. It is understood by those skilled in the art that different promoters may direct the expression of a gene in different tissues or cell types, or at different stages of cell growth and/or development, or in response to different environmental or physiological conditions. Promoters that cause a gene to be expressed in most cell types at most times are commonly referred to as "constitutive promoters". It is further recognized that since in most cases the exact boundaries of regulatory sequences have not been completely defined, DNA fragments of different lengths may have identical promoter activity.

The terms "3' non-coding sequence" "transcription terminator" and "terminator" refer to DNA sequences located 3' downstream of a coding sequence. This includes polyadenylation recognition sequences and other sequences encoding regulatory signals capable of affecting mRNA processing or gene expression. The polyadenylation signal is usually characterized by affecting the addition of polyadenylic acid tracts to the 3' end of the mRNA precursor. The 3' region can influence the transcription, RNA processing or stability, or translation of the associated coding sequence.

The term "operably linked" refers to the association of nucleic acid sequences on a single nucleic acid fragment so that the function of one is affected by the other. For example, a promoter is operably linked with a coding sequence when it is capable of affecting the expression of that coding sequence. That is, the coding sequence is under the transcriptional control of the promoter. Coding sequences can be operably linked to regulatory sequences in sense or antisense orientation.

The term "recombinant" refers to an artificial combination of two otherwise separated segments of sequence, e.g., by chemical synthesis or by the manipulation of isolated segments of nucleic acids by genetic engineering techniques.

The term "expression", as used herein, refers to the transcription and stable accumulation of sense (mRNA) or antisense RNA. Expression also includes translation of mRNA into a polypeptide.

"Transformation" refers to the transfer of a nucleic acid molecule into a host organism. The nucleic acid molecule may be a plasmid that replicates autonomously; or, it may integrate into the genome of the host organism. Host organisms containing the transformed nucleic acid fragments are referred to as "transgenic" or "recombinant" or "transformed" organisms or "transformants".

"Stable transformation" refers to the transfer of a nucleic acid fragment into the genome of a host organism, including both nuclear and organellar genomes, resulting in genetically stable inheritance (i.e., the nucleic acid fragment is "stably integrated"). In contrast, "transient transformation" refers to the transfer of a nucleic acid fragment into the nucleus, or DNA-containing organelle, of a host organism resulting in gene expression without integration or stable inheritance.

The terms "plasmid" and "vector" refer to an extra chromosomal element often carrying genes that are not part of the central metabolism of the cell, and usually in the form of circular double-stranded DNA fragments. Such elements may have autonomously replicating sequences, genome integrating sequences, phage or nucleotide sequences, and may be linear or circular, of a single- or double-stranded DNA or RNA, derived from any source, in which a number of nucleotide sequences have been joined or recombined into a unique construction which is capable of introducing an expression cassette(s) into a cell.

The term "expression cassette" refers to a fragment of DNA comprising the coding sequence of a selected gene and regulatory sequences preceding (5' non-coding sequences) and following (3' non-coding sequences) the coding sequence that are required for expression of the selected gene product. Thus, an expression cassette is typically composed of: 1) a promoter; 2) a coding sequence (i.e., ORF); and, 3) a terminator that usually contains a polyadenylation site in eukaryotes. The expression cassette(s) is usually included within a vector, to facilitate cloning and transformation. Different expression cassettes can be transformed into different organisms including bacteria, yeast, plants and mammalian cells, as long as the correct regulatory sequences are used for each host.

The term "sequence analysis software" refers to any computer algorithm or software program that is useful for the analysis of nucleotide or amino acid sequences. "Sequence analysis software" may be commercially available or independently developed. Typical sequence analysis software will include, but is not limited to: 1) the GCG suite of programs (Wisconsin Package Version 9.0, Genetics Computer Group (GCG), Madison, Wis.); 2) BLASTP, BLASTN, BLASTX (Altschul et al., *J. Mol. Biol.,* 215:403-410 (1990)); 3) DNASTAR (DNASTAR, Inc. Madison, Wis.); 4) Sequencher (Gene Codes Corporation, Ann Arbor, Mich.); and, 5) the FASTA program incorporating the Smith-Waterman algorithm (W. R. Pearson, *Comput. Methods Genome Res.,* [Proc. Int. Symp.] (1994), Meeting Date 1992, 111-20. Editor(s): Suhai, Sandor. Plenum: New York, N.Y.). Within the context of this application it will be understood that where sequence analysis software is used for analysis, that the results of the analysis will be based on the "default values" of the program referenced, unless otherwise specified. As used herein "default values" will mean any set of values or parameters that originally load with the software when first initialized.

"Sequence identity" or "identity" in the context of nucleic acid or polypeptide sequences refers to the nucleic acid bases or amino acid residues in two sequences that are the same when aligned for maximum correspondence over a specified comparison window. Thus, "percentage of sequence identity" or "percent identity" refers to the value determined by comparing two optimally aligned sequences over a comparison window, wherein the portion of the polynucleotide or polypeptide sequence in the comparison window may comprise additions or deletions (i.e., gaps) as compared to the reference sequence (which does not comprise additions or deletions) for optimal alignment of the two sequences. The percentage is calculated by determining the number of positions at which the identical nucleic acid base or amino acid residue occurs in both sequences to yield the number of matched positions, dividing the number of matched positions by the total number of positions in the window of comparison and multiplying the results by 100 to yield the percentage of sequence identity.

Methods to determine "percent identity" and "percent similarity" are codified in publicly available computer programs. Percent identity and percent similarity can be readily calculated by known methods, including but not limited to those described in: 1) *Computational Molecular Biology* (Lesk, A. M., Ed.) Oxford University: NY (1988); 2) *Biocomputing: Informatics and Genome Projects* (Smith, D. W., Ed.) Academic: NY (1993); 3) *Computer Analysis of Sequence Data, Part I* (Griffin, A. M., and Griffin, H. G., Eds.) Humania: NJ (1994); 4) *Sequence Analysis in Molecular Biology* (von Heinje, G., Ed.) Academic (1987); and, 5) *Sequence Analysis Primer* (Gribskov, M. and Devereux, J., Eds.) Stockton: NY (1991).

Sequence alignments and percent identity or similarity calculations may be determined using a variety of comparison methods designed to detect homologous sequences including, but not limited to, the MegAlign™ program of the LASERGENE bioinformatics computing suite (DNASTAR Inc., Madison, Wis.). Alternately, the "BLASTN method of alignment" is an algorithm provided by the National Center for Biotechnology Information ["NCBI"] to compare nucleotide sequences using default parameters, while the "BLASTP method of alignment" is an algorithm provided by the NCBI to compare protein sequences using default parameters.

Standard recombinant DNA and molecular cloning techniques used herein are well known in the art and are described by Sambrook, J., Fritsch, E. F. and Maniatis, T., Molecular Cloning: A Laboratory Manual, $2^{nd}$ ed., Cold Spring Harbor Laboratory: Cold Spring Harbor, N.Y. (1989) (hereinafter "Maniatis"); by Silhavy, T. J., Bennan, M. L. and Enquist, L. W., Experiments with Gene Fusions, Cold Spring Harbor Laboratory: Cold Spring Harbor, N.Y. (1984); and by Ausubel, F. M. et al., Current Protocols in Molecular Biology, published by Greene Publishing Assoc. and Wiley-Interscience, Hoboken, N.J. (1987).

Figure 1A:
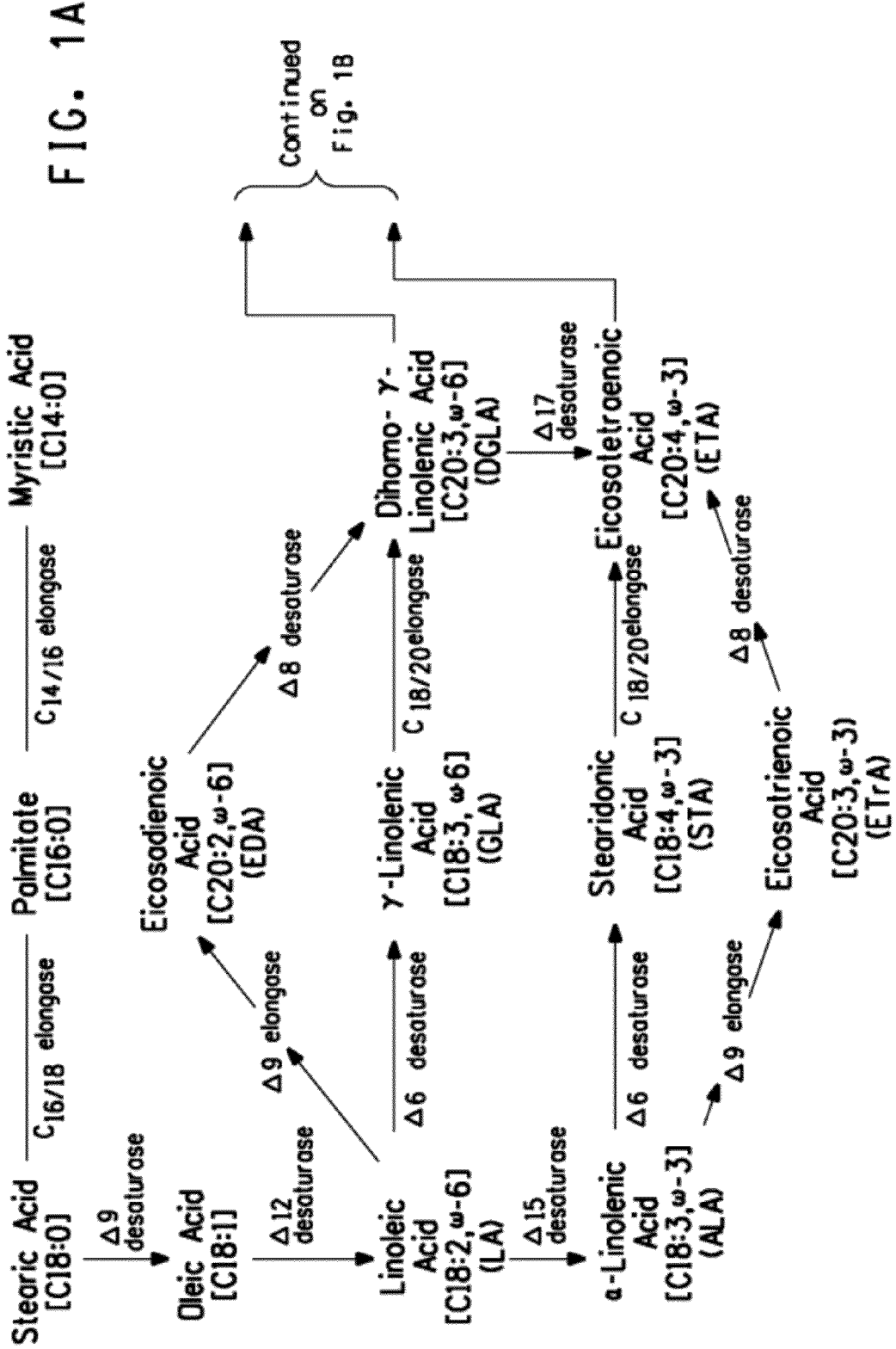
Figure 1B:
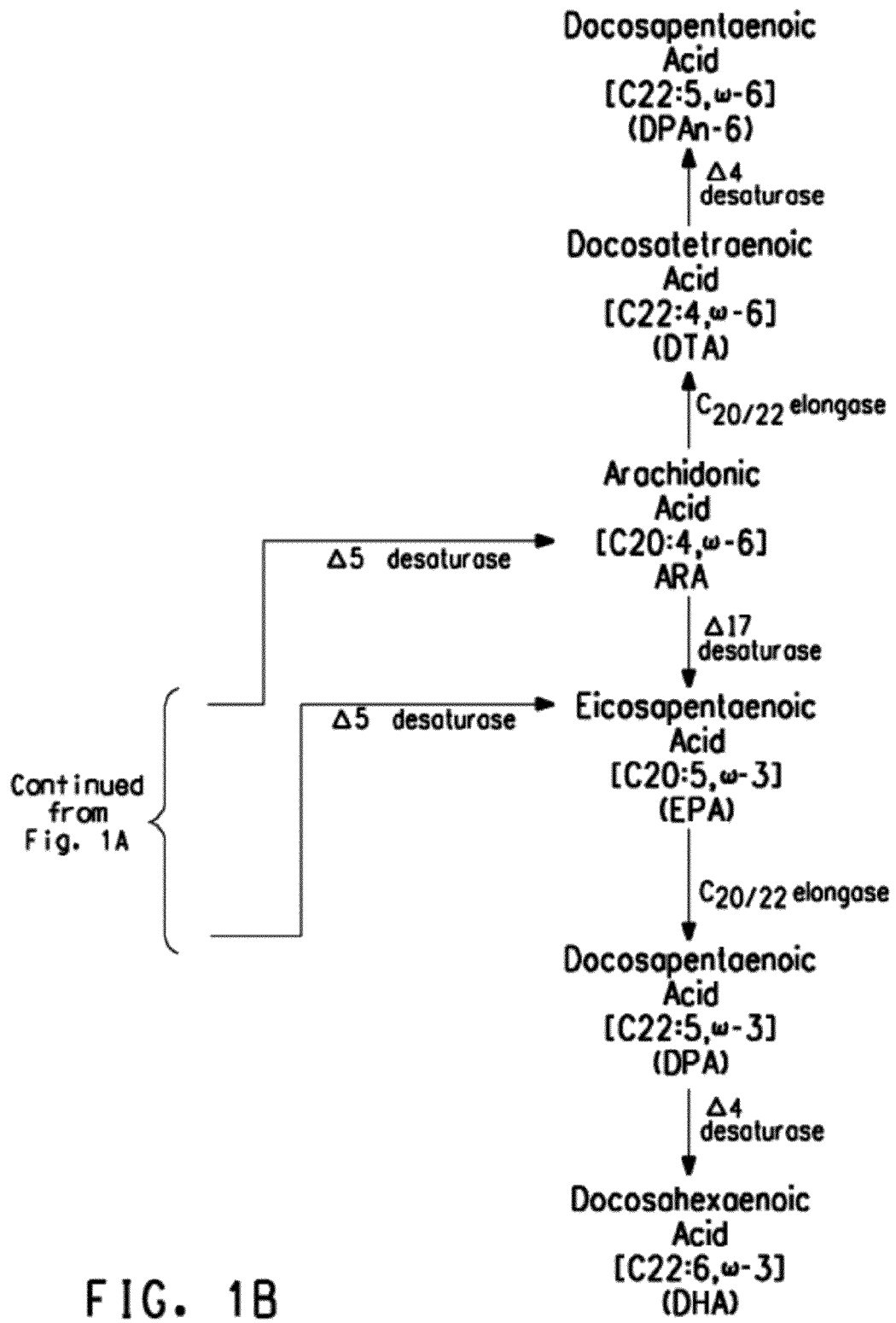

FIG. 1A and FIG. 1B together depict multiple pathways for EPA production, as described below. All pathways require the initial conversion of oleic acid to linoleic acid ["LA"], the first of the omega-6 fatty acids, by a delta-12 desaturase. Then, using the "delta-9 elongase/delta-8 desaturase pathway" and LA as substrate, long-chain omega-6 fatty acids are formed as follows: 1) LA is converted to eicosadienoic acid ["EDA"] by a delta-9 elongase; 2) EDA is converted to dihomo-γ-linolenic acid ["DGLA"] by a delta-8 desaturase; 3) DGLA is converted to arachidonic acid ["ARA"] by a delta-5 desaturase; 4) ARA is converted to docosatetraenoic acid ["DTA"] by a $C_{20-22}$ elongase; and, 5) DTA is converted to docosapentaenoic acid ["DPAn-6"] by a delta-4 desaturase.

The "delta-9 elongase/delta-8 desaturase pathway" can also use α-linolenic acid ["ALA"] as substrate to produce long-chain omega-3 fatty acids as follows: 1) LA is converted to ALA, the first of the omega-3 fatty acids, by a delta-15 desaturase; 2) ALA is converted to eicosatrienoic acid ["ETrA"] by a delta-9 elongase; 3) ETrA is converted to eicosatetraenoic acid ["ETA"] by a delta-8 desaturase; 4) ETA is converted to eicosapentaenoic acid ["EPA"] by a delta-5 desaturase; 5) EPA is converted to docosapentaenoic acid ["DPA"] by a $C_{20-22}$ elongase; and, 6) DPA is converted to docosahexaenoic acid ["DHA"] by a delta-4 desaturase. Optionally, omega-6 fatty acids may be converted to omega-3 fatty acids. For example, ETA and EPA are produced from DGLA and ARA, respectively, by delta-17 desaturase activity. Advantageously for the purposes herein, the delta-9 elongase/delta-8 desaturase pathway enables production of an EPA oil that lacks significant amounts of γ-linolenic acid ["GLA"].

Alternate pathways for the biosynthesis of omega-3/omega-6 fatty acids utilize a delta-6 desaturase and $C_{18/20}$ elongase, that is, the "delta-6 desaturase/delta-6 elongase pathway". More specifically, LA and ALA may be converted to to GLA and stearidonic acid ["STA"], respectively, by a delta-6 desaturase; then, a $C_{18/20}$ elongase converts GLA to DGLA and/or STA to ETA.

Economical commercial production of EPA in a recombinant microbial host cell requires consideration of a variety of variables, including the EPA concentration ["EPA % TFAs"], total lipid content ["TFAs % DCW"] and EPA productivity ["EPA % DCW"]. Furthermore, it is desirable to reduce the production of intermediate fatty acids and byproduct fatty acids in the final oil product, in order to maximize production of the desired fatty acid, i.e., EPA.

Intermediate fatty acids are those fatty acids (e.g., oleic acid, LA, ALA, EDA, DGLA, ETA) that can be further converted to EPA by the action of other metabolic pathway enzymes. In contrast, by-product fatty acids (e.g., sciadonic acid, juniperonic acid) refer to any fatty acid produced that is neither EPA nor an intermediate fatty acid that can be further converted to EPA.

U.S. Pat. Appl. Pub. No. 2009-0093543-A1 describes optimized strains of recombinant *Yarrowia lipolytica* having the ability to produce microbial oils comprising at least about 43.3 EPA % TFAs, with less than about 23.6 LA % TFAs (an EPA:LA ratio of 1.83). The preferred strain was Y4305, whose maximum production was 55.6 EPA % TFAs, with an EPA:LA ratio of 3.03. Generally, the EPA strains of U.S. Pat. Appl. Pub. No. 2009-0093543-A1 comprised the following genes of the omega-3/omega-6 fatty acid biosynthetic pathway:

a) at least one gene encoding delta-9 elongase; and,
b) at least one gene encoding delta-8 desaturase; and,
c) at least one gene encoding delta-5 desaturase; and,
d) at least one gene encoding delta-17 desaturase; and,
e) at least one gene encoding delta-12 desaturase; and,
f) at least one gene encoding $C_{16/18}$ elongase; and,
g) optionally, at least one gene encoding diacylglycerol cholinephosphotransferase (CPT1).

Examples of preferred genes having the enzymatic functionalities described above are set forth in Table 3 of U.S. Pat. Appl. Pub. No. 2009-0093543-A1. These genes are not intended to be limiting; instead, the genes of U.S. Pat. Appl. Pub. No. 2009-0093543-A1 should serve as a useful reference to guide in the selection of appropriate genes of the omega-3/omega-6 fatty acid biosynthetic pathway having delta-9 elongase, delta-8 desaturase, delta-5 desaturase, delta-17 desaturase, delta-12 desaturase, $C_{16/18}$ elongase and/or CPT1 functionality.

As one of skill in the art will appreciate, each specific host cell will exhibit "codon-bias" in usage of nucleotide codons to specify a given amino acid. Thus, it will be desirable to design each particular delta-9 elongase, delta-8 desaturase, delta-5 desaturase, delta-17 desaturase, delta-12 desaturase, $C_{16/18}$ elongase and/or CPT1 gene such that its frequency of codon usage approaches the frequency of preferred codon usage of the recombinant microbial host cell that is to be engineered for production of EPA.

It is well understood by one skilled in the art that many levels of sequence identity are useful in identifying polypeptides, from other species, wherein such polypeptides have the same or similar function or activity. Preferred nucleic acid fragments, i.e., isolated polynucleotides encoding delta-9 elongase, delta-8 desaturase, delta-5 desaturase, delta-17 desaturase, delta-12 desaturase, $C_{16/18}$ elongase and/or CPT1 polypeptides, encode polypeptides that are at least about 70-80% identical to those described in Table 3 of U.S. Pat. Appl. Pub. No. 2009-0093543-A1, while more preferred nucleic acid fragments encode amino acid sequences that are at least about 80-85% or at least about 85-90% or even at least about 90-95% identical.

U.S. Pat. Appl. Pub. No. 2010-0317072-A1 describes optimized strains of recombinant *Yarrowia lipolytica* having the ability to produce improved microbial oils relative to those strains described in U.S. Pat. Appl. Pub. No. 2009-0093543-A1, based on the EPA % TFAs and the ratio of EPA:LA. The preferred strain was Y9502, whose maximum production was 57 EPA % TFAs, with an EPA:LA ratio of 4.49 and an EPA productivity of 21.3 EPA % DCW. In addition to expressing genes of the omega-3/omega-6 fatty acid biosynthetic pathway as detailed in U.S. Pat. Appl. Pub. No. 2009-0093543-A1, these improved strains are distinguished by:

1) comprising at least one multizyme, wherein said multizyme comprises a polypeptide having at least one fatty acid delta-9 elongase linked to at least one fatty acid delta-8 desaturase [a "DGLA synthase"];
2) optionally comprising at least one polynucleotide encoding an enzyme selected from the group consisting of a malonyl CoA synthetase ["MCS"] or an acyl-CoA lysophospholipid acyltransferase ["LPLAT"];
3) comprising at least one peroxisome biogenesis factor protein whose expression has been down-regulated;
4) producing at least about 50 EPA % TFAs; and,
5) having a ratio of EPA:LA of at least about 3.1.

The multizyme linker is preferably selected from the group consisting of: SEQ ID NO:4, SEQ ID NO:5, SEQ ID NO:6, SEQ ID NO:7, SEQ ID NO:8, SEQ ID NO:9 and SEQ ID NO:10; and, the multizyme is preferably a sequence consisting essentially of a sequence selected from the group consisting of: EgD9eS/EgD8M (SEQ ID NO:12), EaD9eS/EaD8S (SEQ ID NO:14) and E389D9eS/EgD8M (SEQ ID NO:16). The at least one peroxisome biogenesis factor protein whose expression has been down-regulated is preferably selected from the group consisting of: Pex1p (SEQ ID NO:51), Pex2p (SEQ ID NO:52), Pex3p (SEQ ID NO:53), Pex3Bp (SEQ ID NO:54), Pex4p (SEQ ID NO:55), Pex5p (SEQ ID NO:56), Pex6p (SEQ ID NO:57), Pex7p (SEQ ID NO:58), Pex8p (SEQ ID NO:59), Pex10p (SEQ ID NO:60), Pex12p (SEQ ID NO:61), Pex13p (SEQ ID NO:62), Pex14p (SEQ ID NO:63), Pex16p (SEQ ID NO:64), Pex17p (SEQ ID NO:65), Pex19p (SEQ ID NO:66), Pex20p (SEQ ID NO:67), Pex22p (SEQ ID NO:68) and Pex26p (SEQ ID NO:69), wherein Pex3p knockouts are particularly preferred.

Although the above sequences are preferred for use in a recombinant *Yarrowia* host cell, these genes are not intended to be limiting. As previously discussed with respect to the particular desaturases and elongases expressed within a recombinant microbial host cell, the "codon-bias" in usage of nucleotide codons to specify a given amino acid must be considered. One may therefore apply the teachings set forth in U.S. Pat. Appl. Pub. No. 2010-0317072-A1 concerning design of a DGLA synthase multizyme and preferred Pex gene knockouts to any recombinant microbial host cell that is to be engineered for production of EPA. Preferred nucleic acid fragments, i.e., isolated polynucleotides encoding DGLA synthase and/or Pex polypeptides, encode polypeptides that are at least about 70-80% identical to those described supra, while more preferred nucleic acid fragments encode amino acid sequences that are at least about 80-85% or at least about 85-90% or even at least about 90-95% identical.

Provided herein are further improved optimized recombinant microbial host cells having the ability to produce improved microbial oils relative to those strains described in U.S. Pat. Appl. Pub. No. 2009-0093543-A1 and U.S. Pat. Appl. Pub. No. 2010-0317072-A1, based on increased EPA productivity (i.e., measured as increased EPA % DCW). In addition to expressing genes of the omega-3/omega-6 fatty acid biosynthetic pathway, wherein said genes comprise at least one multizyme (wherein said multizyme comprises a polypeptide having at least one delta-9 elongase linked to at least one delta-8 desaturase, as described in U.S. Pat. Appl. Pub. No. 2010-0317072-A1) and comprising at least one peroxisome biogenesis factor protein whose expression has been down-regulated (as described in U.S. Pat. Appl. Pub. No. 2010-0317072-A1), the improved recombinant microbial host cells disclosed herein are distinguished by:

1) comprising at least two polypeptides having at least lysophosphatidic acid acyltransferase ["LPAAT"] activity;

2) comprising at least one polypeptide having at least phospholipid:diacylglycerol acyltransferase ["PDAT"] activity;
3) optionally comprising at least one mutant delta-9 elongase polypeptide, wherein said mutant delta-9 elongase polypeptide comprises an amino acid sequence as set forth in SEQ ID NO:1, wherein SEQ ID NO:1 differs from SEQ ID NO:3 by at least one amino acid mutation, said mutation(s) selected from the group consisting of:
   i) a L35F mutation;
   ii) a L35M mutation;
   iii) a L35G mutation;
   iv) a L35G mutation and at least one other mutation selected from the group consisting of: S9A, S9D, S9G, S9I, S9K, S9Q, Q12K, A21D, A21T, A21V, V32F, Y84C, Q107E, L108G, G127L, W132T, M143N, M143W, L161T, L161Y, W168G, I179M, I179R, C236N, Q244N, A254W and A254Y;
   v) L35G, A21V, L108G and I179R mutations;
   vi) L35G, W132T and I179 mutations; vii) L35G, S9D, Y84C and I179R mutations;
   viii) L35G, Y84C, I179R and Q244N mutations;
   ix) L35G, A21V, W132T, I179R and Q244N mutations;
   x) K58R and I257T mutations;
   xi) a D98G mutation;
   xii) L130M and V243A mutations; and,
   xiii) any combination comprising at least two mutations, wherein the mutations are selected from the group consisting of: K58R, L35F, L35G, L35M, S9A, S9D, S9G, S9I, S9K, S9Q, Q12K, A21D, A21T, A21V, V32F, Y84C, D98G, Q107E, L108G, G127L, L130M, W132T, M143N, M143W, L161T, L161Y, W168G, I179M, I179R, C236N, V243A, Q244N, A254W, A254Y and I257T; and,
4) producing a microbial oil comprising at least 25 wt % of EPA measured as a wt % of DCW.

As noted above, the improved recombinant microbial host cells disclosed herein are unique in that the strains possess at least two polypeptides having at least LPAAT activity and at least one polypeptide having at least PDAT activity; thus, up-regulation of components of the de novo glycerophospholipid biosynthetic pathway is desired.

Glycerophospholipids, the main component of biological membranes, contain a glycerol core with fatty acids attached as R groups at the sn-1 position and sn-2 position, and a polar head group joined at the sn-3 position via a phosphodiester bond (see, U.S. Pat. Appl. Pub. No. 2010-0317882-A1). Glycerophospholipids possess tremendous diversity, not only resulting from variable phosphoryl head groups, but also as a result of differing chain lengths and degrees of saturation of their fatty acids. Generally, saturated and monounsaturated fatty acids are esterified at the sn-1 position, while PUFAs are esterified at the sn-2 position.

Glycerophospholipid biosynthesis is complex. Table 3 below summarizes the steps in the de novo pathway, originally described by Kennedy and Weiss (*J. Biol. Chem.*, 222: 193-214 (1956)):

TABLE 3

General Reactions Of de Novo Glycerophospholipid Biosynthesis

| Reaction | Catalyzing Enzyme |
| --- | --- |
| sn-Glycerol-3-Phosphate → Lysophosphatidic Acid (1-acyl-sn-glycerol 3-phosphate or "LPA") | Glycerol-3-phosphate acyltransferase (GPAT) [E.C. 2.3.1.15] esterifies $1^{st}$ acyl-CoA to sn-1 position of sn-glycerol 3-phosphate |
| LPA → Phosphatidic Acid (1,2-diacylglycerol phosphate or "PA") | Lysophosphatidic acid acyltransferase (LPAAT) [E.C. 2.3.1.51] esterifies $2^{nd}$ acyl-CoA to sn-2 position of LPA |
| PA → 1,2-Diacylglycerol ("DAG") Or PA → Cytidine Diphosphate Diacylglycerol ("CDP-DG") | Phosphatidic acid phosphatase [E.C. 3.1.3.4] removes a phosphate from PA; DAG can subsequently be converted to phosphatidylcholines ["PC"], phosphatidylethanolamines ["PE"], or triacylglycerols ["TAG"], wherein TAG synthesis requires either a diacylglycerol acyltransferase (DGAT) [E.C. 2.3.1.20] or a phospholipid:diacylglycerol acyltransferase (PDAT) [E.C.2.3.1.158] CDP-diacylglycerol synthase [EC 2.7.7.41] causes condensation of PA and cytidine triphosphate, with elimination of pyrophosphate; CDP-DG can subsequently be converted to phosphatidylinositols ["PI"], phosphatidylserines ["PS"], phosphatidylglycerols ["PG"] or cardiolipins ["CL"] |

Following their de novo synthesis, glycerophospholipids can undergo rapid turnover of the fatty acyl composition at the sn-2 position. This "remodeling", or "acyl editing", is important for membrane structure and function, biological response to stress conditions, and manipulation of fatty acid composition and quantity in biotechnological applications. Specifically, the remodeling has been attributed to deacylation of the glycerophospholipid and subsequent reacylation of the resulting lysophospholipid (i.e., such that acyl-CoA fatty acids are removed from the cellular acyl-CoA pool and various lysophospholipid substrates are acylated at the sn-2 position in the phospholipid pool).

A variety of studies have contemplated the beneficial effects of co-expressing acyl-CoA:lysophospholipid acyltransferases ["LPLATs"] with PUFA biosynthetic genes, to increase the amount of a desired fatty acid in the oil of a transgenic organism, increase total oil content or selectively increase the content of desired fatty acids, since fatty acid biosynthesis requires rapid exchange of acyl groups between the acyl-CoA pool and the phospholipid pool (i.e., desaturations occur mainly at the sn-2 position of phospholipids, while elongation occurs in the acyl-CoA pool) (see, Intl. App.

Publications No. WO 2004/076617, No. WO 2004/087902, No. WO 2006/069936, No. WO 2006/052870, No. WO 2009/001315, No. WO 2009/014140). However, the work disclosed in U.S. Pat. Appl. Pub. No. 2010-0317882-A1 was the first study conducted to examine the effect of LPAATs and LPCATs in an oleaginous organism engineered for high-level production of EPA.

More specifically, Examples 3, 4, 7 and 8 of U.S. Pat. Appl. Pub. No. 2010-0317882-A1 compare the effects of overexpression of ScLPAAT1S, MaLPAAT1S and YlLPAAT1 (as described below in Table 4) in recombinant strain Y8406 of *Yarrowia lipolytica*, engineered for production of ~51% EPA relative to the total lipids via expression of a delta-9 elongase/delta-8 desaturase pathway.

sion occurred via plasmid expression as opposed to via chromosomal integration, a phenomenum likely attributed to the "position effects" of chromosomal integration and/or different growth conditions; alternately, loss of the plasmid could also contribute to the observed results. In any case, however, the results in Table 4 demonstrate that LPAAT overexpression resulted in significant reduction in the concentration of LA (18:2) as a weight % of TFAs ["LA % TFAs"], an increase in the concentration of EPA as a weight % of TFAs ["EPA % TFAs"], and an increase in the conversion efficiency of delta-9 elongase(s), when each of these parameters was compared to the control.

Based on the results summarized above, the improved optimized strains of recombinant microbial host cells having the

TABLE 4

Summary Of LPAATs And Effect Of LPAAT Overexpression In Transformant Strains Of *Yarrowia lipolytica* Y8406

| Organism | References | Wildtype Abbreviation and SEQ ID NO | Codon-Optimized Abbreviation* and SEQ ID NO | Effect Of Overexpression, Relative to Control | | |
|---|---|---|---|---|---|---|
| | | | | LA % TFAs | EPA % TFAs | Delta-9 Elongase Conversion Efficiency** |
| *Saccharomyces cerevisiae* | ORF "YDL052C"; GenBank Accession No. NP_010231 | "ScLPAAT" (SEQ ID NO: 23) | "ScLPAATS" (SEQ ID NOs: 24 and 25) | 72-74% of control (plasmid expression) | 104-106% of control (plasmid expression) | 108-109% of control (plasmid expression) |
| *Mortierella alpina* | U.S. Pat. No. 7,879,591 | "MaLPAAT1" (SEQ ID NOs: 17 and 18) | "MaLPAAT1S" (SEQ ID NOs: 19 and 20) | 55-56% of control (chromosomal integration) | 112% of control (chromosomal integration) | 118-119% of control (chromosomal integration) |
| *Yarrowia lipolytica* | ORF "YALI0E18964g"; GenBank Accession No. XP_504127; U.S.Pat. No. 7,189,559 | "YlLPAAT1" (SEQ ID NOs: 21 and 22) | — | 63% of control (chromosomal integration); 76% of control (plasmid expression) | 115% of control (chromosomal integration); 101% of control (plasmid expression) | 115% of control (chromosomal integration); 107% of control (plasmid expression) |

*Codon-optimization is for expression in *Yarrowia lipolytica*, as described in U.S. Pat. No. 7,125,672. To include an efficient yeast translation initiation sequence and obtain optimal gene expression, the synthetic, codon-optimized genes in this organism were frequently altered to include the following consensus sequence around the translational initiation codon 'ATG': MAMMATGNHS (SEQ ID NO: 70), wherein the nucleic acid degeneracy code used is as follows: M = A/C; S = C/G; H = A/C/T; and N = A/C/G/T.
**Conversion efficiency was calculated according to the formula: product(s)/(product(s) + substrate) * 100, where product includes both product and product derivatives. This is a measure of the enzyme's ability to convert substrate to product.

MaLPAAT1 and YlLPAAT1 shared 34.0% sequence identity, while ScLPAAT and YlLPAAT1 shared 43.9% sequence identity; all three of the wildtype proteins possessed the 1-acyl-sn-glycerol-3-phosphate acyltransferase family motifs set forth as NHxxxxD (SEQ ID NO:26) and EGTR (SEQ ID NO:27), as described by Lewin, T. W. et al. (*Biochemistry*, 38:5764-5771 (1999)) and Yamashita et al. (*Biochim, Biophys. Acta*, 1771:1202-1215 (2007)).

Overexpression of ScLPAAT1S, MaLPAAT1S and YlLPAAT1 in *Yarrowia lipolytica* was analyzed after: (a) linearized DNA carrying either MaLPAAT1S or YlLPAAT1 was transformed by chromosomal integration to result in stable integrations, wherein transformants were grown in a relatively rich, non-selective medium; or, (b) circular plasmid DNA carrying an autonomously replicating sequence and either YlLPAAT or ScLPAAT1S was transformed, and transformants were grown on selective medium [i.e., labeled as either "chromosomal integration" or "plasmid expression" in Table 4]. Results were minimized when LPAAT overexpresability to produce improved EPA % DCW therefore comprise at least two LPAATs selected from the group consisting of:
(a) a sequence consisting essentially of a sequence selected from the group consisting of SEQ ID NO:18 (MaLPAAT1), SEQ ID NO:20 (MaLPAAT1S), SEQ ID NO:22 (YlLPAAT1), SEQ ID NO:23 (ScLPAAT1) and SEQ ID NO:25 (ScLPAAT1S); and,
(b) a polypeptide having at least 43.9% amino acid identity, based on the Clustal W method of alignment, when compared to an amino acid sequence selected from the group consisting of SEQ ID NO:18 (MaLPAAT1), SEQ ID NO:22 (YlLPAAT1) and SEQ ID NO:23 (ScLPAAT1) and further comprising at least one 1-acyl-sn-glycerol-3-phosphate acyltransferase family motif selected from the group consisting of: SEQ ID NO:26 and SEQ ID NO:27.

For clarify, the at least two LPAATs can be either: 1) two copies of an identical coding sequence for a particular LPAAT isolated from a single species; or, 2) one coding sequence for a LPAAT isolated from species "A" and one coding sequence for a LPAAT isolated from species "B", thus collectively resulting in two LPAATs.

The optimized recombinant microbial host cells of the present invention will also comprise at least one polypeptide having PDAT activity. Dahlqvist et al. (*Proc. Nat. Acad. Sci. (USA)*, 97:6487-6492 (2000)) and Oelkers et al. (*J. Biol. Chem.*, 275:15609-15612 (2000)) were the first to appreciate that TAG synthesis can occur in the absence of acyl-CoA, via the acyl-CoA-independent PDAT enzyme (structurally related to the lecithin:cholesterol acyltransferase family of proteins). More specifically, Dahlqvist et al. and Oelkers et al. demonstrated that overexpression of the *Saccharomyces cerevisiae* LRO1 gene encoding PDAT (SEQ ID NO:30; "ScPDAT") resulted in an increased TAG content, while deletion of ScPDAT caused significant reduction of TAG synthesis. Following this work, U.S. Pat. No. 7,267,976 described the cloning, overexpression and knockout of the *Yarrowia lipolytica* ATCC #90812 gene encoding PDAT (i.e., SEQ ID NOs: 28 and 29 herein), which was determined to share 47.1% amino acid sequence identity with ScPDAT. *Y. lipolytica* strains having a disrupted PDAT were found to have lower oil content ["TFAs DOW"] as compared to the wild type strain (ca. 29-38%), while strains having a disruption in both PDAT2 and DGAT2 were determined to have only 17-27% oil content when compared to the control. The *Y. lipolytica* PDAT was then expressed in a *S. cerevisiae* strain having a disruption in its native PDAT and DGAT2 genes; TFAs % DCW was doubled in the transformant strains as compared to the control.

Based on the discussion above, one of skill in the art will appreciate the role PDAT plays in modifying total lipid content. The recombinant microbial host cells described herein will therefore comprise at least one PDAT selected from the group consisting of:
  (a) a sequence consisting essentially of a sequence selected from the group consisting of SEQ ID NO:29 and SEQ ID NO:30 and,
  (b) a polypeptide having at least about 90% amino acid identity, or more preferably at least about 95% amino acid identity, based on the Clustal W method of alignment, when compared to an amino acid sequence selected from the group consisting of SEQ ID NO:29 and SEQ ID NO:30.

Recently, considerable effort has been invested by E.I. duPont de Nemours & Company to identify delta-9 elongase mutants having high activity that are well suited for integration into PUFA biosynthetic pathways in commercially useful recombinant microbial host cells, since previous studies have shown that delta-9 elongation (as well delta-6 elongation) is a bottleneck in long chain PUFA biosynthesis due to poor transfer of acyl groups between phospholipid and acyl-CoA pools. As described in U.S. Provisional Application No. 61/377,248, filed Aug. 26, 2010, incorporated by reference in its entirety and set forth herein as Examples 10A-10J, specific mutations were identified in mutant EgD9eS polypeptides (i.e., derived from EgD9eS [SEQ ID NO:3]) that resulted in up to 45% improvement in enzymatic activity, based on conversion of LA to EDA, when compared to the enzymatic activity of SEQ ID NO:3.

More specifically, a rationale targeted approach to identify suitable mutations within delta-9 elongases was not ideal based on the lack of any crystal structures from delta-9 elongases and only a single study concerning the importance of the Gln residue in the variant histidine-box ["His-box"] motif of the Isochrysis galbana delta-9 elongase ["IgD9e"; SEQ ID NOs:41 and 42] (Qi, B., et al., *FEBS Lett.*, 547:137-139 (2003)). IgD9e, the first PUFA-specific elongase identified with delta-9 elongase activity, was found to have a Gln-Xaa-Xaa-His-His ["QxxHH"; SEQ ID NO:71] motif, instead of the highly conserved His-Xaa-Xaa-His-His ["HxxHH"; SEQ ID NO:72] motif present in delta-6 elongases. Qi, B., et al. demonstrated that substitution of the Gln with His, Ala or Phe residues resulted in lower delta-9 elongase activity in each of the mutant IgD9e polypeptides analyzed therein and thus it was concluded that "the glutamine residue in the histidine box . . . appears to be essential for optimum enzyme catalysis".

In addition to the work of Qi et al., seven motifs were known to be conserved between and among IgD9e (SEQ ID NO:42), the *Euglena gracilis* delta-9 elongase ["EgD9e"; SEQ ID NO:32; U.S. Pat. No. 7,645,604], and the *Eutreptiella* sp. CCMP389 delta-9 elongase ["E389D9e"; SEQ ID NO:38; U.S. Pat. No. 7,645,604]. These motifs were described in U.S. Pat. No. 7,645,604 and include: Y-N-X-(L or F)-$X_4$-S-$X_2$-S-F (SEQ ID NO:73); F-Y-X-K-$X_2$-(E or D)-Y-X-D-(T or $\overline{S}$)-$X_2$-L (SEQ ID NO:74); L-(Q or H)-X-$\overline{F}$-H-H-X-G-A (SEQ $\overline{ID}$ NO:75); M-Y-X-Y-Y-$X_7$-(K or R or $\overline{N}$)-F (SEQ ID NO:76); K-X-L-(I or L or M)-T-$X_2$-Q (SEQ ID NO:$\overline{77}$); W-X-F-N-Y-X-Y $\overline{(SEQ}$ ID NO:78); and Y-X-G-X-V-$X_2$-L-F ($\overline{SEQ}$ $\overline{ID}$ NO:79); wherein X can be any amino ac$\overline{id}$ and the underlined amino acids may be unique to delta-9 elongases.

Libraries of mutant sequences encoding delta-9 elongases were thus synthetically engineered by error-prone PCR ["ePCR"], using EgD9eS (SEQ ID NO:2) as a template, wherein EgD9eS was contained within a plasmid construct comprising a chimeric FBAINm::EgD9eS::Pex20 gene. The ePCR libraries were then transformed into *Yarrowia lipolytica*, and screened for improved delta-9 elongase activity based on GC analyses and the production of EDA.

Many clones were identified that resulted in a completely non-functional mutant delta-9 elongase (i.e., having no detectable delta-9 elongase activity) or a mutant delta-9 elongase having substantially decreased delta-9 elongase activity with respect to the wildtype enzyme, EgD9eS. Surprisingly, however, various mutations that resulted in an improved LA to EDA conversion efficiency [calculated as ([EDA]/[LA+EDA])*100] were identified. Specifically, five individual transformants were identified comprising four different mutant delta-9 elongase genes (i.e., comprising a K58R/I257T mutation, a L35F mutation, a D98G mutation and a L130M/V243A mutation, respectively, when compared to the protein sequence of EgD9eS [SEQ ID NO:3]), wherein the delta-9 elongase conversion activity ranged from 105% to 117% of wild type EgD9eS (Table 5, infra), corresponding to a 5-17% improvement. This work therefore demonstrated that the delta-9 elongase activity of EgD9eS could indeed be improved by protein engineering.

The initial data obtained from the above EgD9eS ePCR libraries was then utilized to rationally identify two different amino acid residues within EgD9eS that were appropriate targets for the creation of site-saturation libraries (i.e., residues 35 and 107). Again, the effect of each mutation on the delta-9 elongase activity of the resulting mutant EgD9eS was screened, thus enabling identification of two additional mutations that resulted in an improved LA to EDA conversion efficiency. Specifically, transformant strains were identified comprising either a L35G mutation or a L35M/Q107E mutation within the mutant delta-9 elongase, wherein the delta-9 elongase conversion activity was either 142%-145% or 132% of wild-type EgD9eS (Table 5, infra), corresponding to a 32-45% improvement.

Following identification of the L35G mutation, a subsequent library targeting 50 different amino acid residues was created using SlonoMax® technology and the EgD9eS-L35G gene as a target. Twenty-five different mutations were identified, each in combination with the L35G mutation, which resulted in delta-9 elongase conversion activity from 96% to 141% when compared to the parent elongase, i.e., EgD9eS-L35G (Table 5, infra), corresponding to a −4% to 41% improvement.

Finally, recent work has attempted to combine (or "stack") multiple beneficial mutations identified within the Slono-Max® library, thereby "stacking" appropriate individual amino acid mutations within the synthetic codon-optimized EgD9eS sequence. Thus, for example, a mutant delta-9 elongase comprising A21V, L35G, W132T, I179R and Q244N mutations with respect to SEQ ID NO:3 has been demonstrated to result in 123% improvement in delta-9 elongase conversion activity relative to EgD9eS (Table 5, infra) corresponding to a 23% improvement.

Figure 16A:
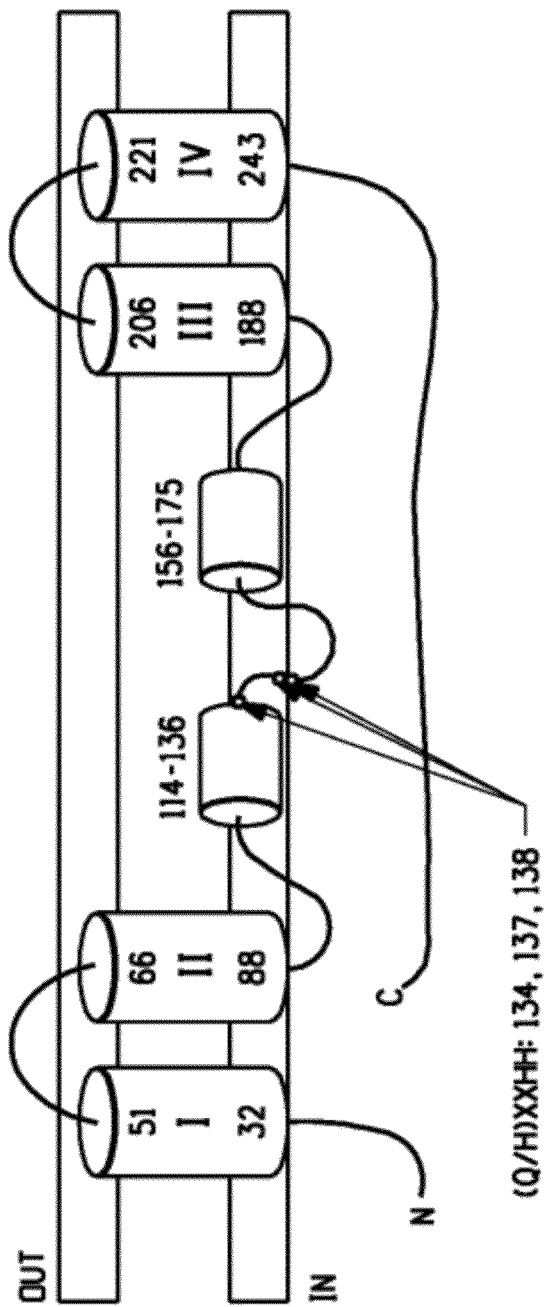
Figure 16B:
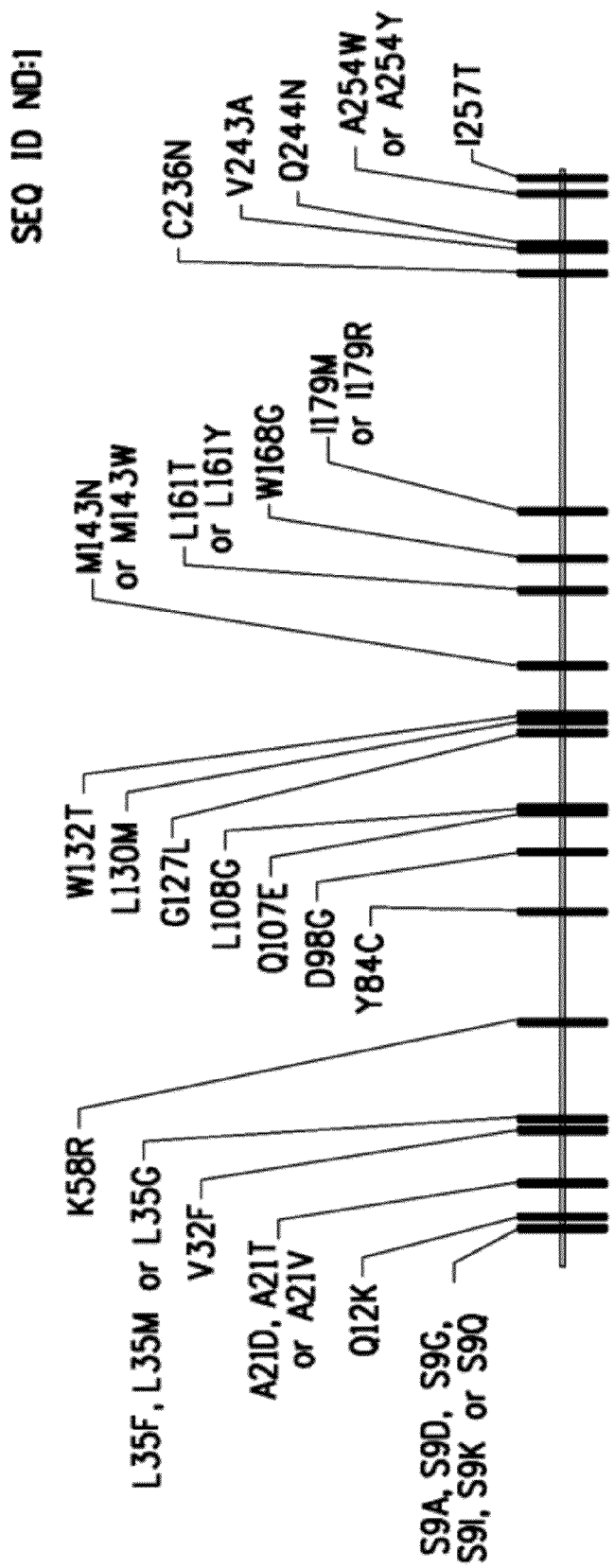

As a result of the work detailed above, the recombinant microbial host cells described herein may therefore comprise at least one mutant delta-9 elongase polypeptide, wherein said mutant delta-9 elongase polypeptide comprises an amino acid sequence as set forth in SEQ ID NO:1, wherein SEQ ID NO:1 differs from SEQ ID NO:3 by at least one amino acid mutation, as represented in FIG. 16B, said mutation(s) selected from the group consisting of:
  i) a L35F mutation;
  ii) a L35M mutation;
  iii) a L35G mutation;
  iv) a L35G mutation and at least one other mutation selected from the group consisting of: S9A, S9D, S9G, S9I, S9K, S9Q, Q12K, A21D, A21T, A21V, V32F, Y84C, Q107E, L108G, G127L, W132T, M143N, M143W, L161T, L161Y, W168G, I179M, I179R, C236N, Q244N, A254W and A254Y;
  v) L35G, A21V, L108G and I179R mutations;
  vi) L35G, W132T and I179 mutations;
  vii) L35G, S9D, Y84C and I179R mutations;

TABLE 5

Summary Of Mutants Having Increased Delta-9 Elongase Activity

| Method of Library Generation | Resulting Amino Acid Substitution | Designation For Mutant Gene | Relative Activity |
|---|---|---|---|
| ePCR | L35F | EgD9eS-L35F | 115% [a] |
| | K58R and I257T | EgD9eS-K58R/I257T | 105% [a] |
| | L130M and V243A | EgD9eS-L130M/V243A | 106%-111% [a] |
| | D98G | EgD9eS-D98G | 117% [a] |
| Site-Saturation | L35G | EgD9eS-L35G | 142%-145% [a] |
| SlonoMax ® | L35M and Q107E | EgD9eS-L35M/Q107E | 132% [a] |
| | L35G and S9A | EgD9eS-L35G/S9A | 126% [b] |
| | L35G and S9D | EgD9eS-L35G/S9D | 141% [b] |
| | L35G and S9G | EgD9eS-L35G/S9G | 129% [b] |
| | L35G and S9I | EgD9eS-L35G/S9I | 113% [b] |
| | L35G and S9K | EgD9eS-L35G/S9K | 122% [b] |
| | L35G and S9Q | EgD9eS-L35G/S9Q | 111% [b] |
| | L35G and Q12K | EgD9eS-L35G/Q12K | 123% [b] |
| | L35G and A21D | EgD9eS-L35G/A21D | 118% [b] |
| | L35G and A21T | EgD9eS-L35G/A21T | 110% [b] |
| | L35G and A21V | EgD9eS-L35G/A21V | 118% [b] |
| | L35G and V32F | EgD9eS-L35G/V32F | 104% [b] |
| | L35G and Y84C | EgD9eS-L35G/Y84C | 144% [b] |
| | L35G and L108G | EgD9eS-L35G/L108G | 104% [b] |
| | L35G and G127L | EgD9eS-L35G/G127L | 104% [b] |
| | L35G and W132T | EgD9eS-L35G/W132T | 100% [b] |
| | L35G and M143N | EgD9eS-L35G/M143N | 96% [b] |
| | L35G and M143W | EgD9eS-L35G/M143W | 106% [b] |
| | L35G and L161T | EgD9eS-L35G/L161T | 131% [b] |
| | L35G and L161Y | EgD9eS-L35G/L161Y | 119% [b] |
| | L35G and W168G | EgD9eS-L35G/W168G | 115% [b] |
| | L35G and I179M | EgD9eS-L35G/I179M | 104% [b] |
| | L35G and I179R | EgD9eS-L35G/I179R | 141% [b] |
| | L35G and C236N | EgD9eS-L35G/C236N | 102% [b] |
| | L35G and Q244N | EgD9eS-L35G/Q244N | 134% [b] |
| | L35G and A254W | EgD9eS-L35G/A254W | 112% [b] |
| | L35G and A254Y | EgD9eS-L35G/A254Y | 116% [b] |
| Combinatorial | L35G and W132T and I179R | EgD9eS-L35G/W132T/I179R | 110% [a] |
| Combinatorial | S9D and L35G and Y84C and I179R | EgD9eS-S9D/L35G/Y84C/I179R | 108% [a] |
| Combinatorial | A21V and L35G and L108G and I179R | EgD9eS-A21V/L35G/L108G/I179R | 104% [a] |
| Combinatorial | L35G and Y84C and I179R and Q244N | EgD9eS-L35G/Y84C/I179R/Q244N | 111% [a] |
| Combinatorial | A21V and L35G and W132T and I179R and Q244N | EgD9eS-A21V/L35G/W132T/I179R/Q244N | 123% [a] |

[a] "Relative activity" refers to the delta-9 elongase activity of each mutant EgD9eS with respect to the delta-9 elongase activity of EgD9eS, set forth as SEQ ID NO: 3.
[b] "Relative activity" refers to the delta-9 elongase activity of each mutant EgD9eS with respect to the delta-9 elongase activity of EgD9eS-L35G, set forth as SEQ ID NO: 44.

viii) L35G, Y84C, I179R and Q244N mutations;
ix) L35G, A21V, W132T, I179R and Q244N mutations;
x) K58R and I257T mutations;
xi) a D98G mutation;
xii) L130M and V243A mutations; and,
xiii) any combination comprising at least two mutations, wherein the mutations are selected from the group consisting of: K58R, L35F, L35G, L35M, S9A, S9D, S9G, S9I, S9K, S9Q, Q12K, A21D, A21T, A21V, V32F, Y84C, D98G, Q107E, L108G, G127L, L130M, W132T, M143N, M143W, L161T, L161Y, W168G, I179M, I179R, C236N, V243A, Q244N, A254W, A254Y and I257T.

In preferred embodiments, the mutant EgD9eS comprises at least a L35G mutation with respect to SEQ ID NO:3. For example, the delta-9 elongase activity of the mutant delta-9 elongase polypeptide described herein as "EgD9eS-L35G", as set forth in SEQ ID NO:44, having a single L35G mutation with respect to SEQ ID NO:3, was 142-145% relative to the delta-9 elongase activity of EgD9eS, corresponding to a 42-45% improvement.

In addition to expressing at least two LPAATs, at least one PDAT and (optionally) at least one mutant delta-9 elongase as described above, as well as the genes encoding the delta-9 elongase/delta-8 desaturase omega-3/omega-6 fatty acid biosynthetic pathway for EPA biosynthesis (i.e., comprising at least one delta-9 elongase, at least one delta-8 desaturase, at least one delta-5 desaturase, at least one delta-17 desaturase, at least one delta-12 desaturase and at least one $C_{16/18}$ elongase, wherein at least one multizyme comprising at least one delta-9 elongase linked to at least one delta-8 desaturase is present), the recombinant host cell of the invention producing at least 25 EPA % DCW may optionally express various other heterologous genes. These may include, for example, genes encoding cholinephosphate cytidylyltransferase ["PCT"], diacylglycerol cholinephosphotransferase ["CPT1"], malonyl CoA synthetase ["MCS"], and/or delta-9 desaturase, as elaborated infra.

The phosphatidylcholine ["PC"] biosynthetic pathway comprises three steps:
(i) ATP+choline→ADP+O-phosphocholine, catalyzed by a choline kinase [EC 2.7.1.32];
(ii) cytidine triphosphate ["CTP"]+choline phosphate ⇌ diphosphate+cytidine diphosphate-choline ["CDP-choline"], catalyzed by a choline phosphate cytidylyltransferase ["PCT"; EC 2.7.7.15]; and,
(iii) CDP-choline+1,2-diacylglycerol⇌cytidine-5'-monophosphate ["CMP"]+a phosphatidylcholine, catalyzed by a diacylglycerol cholinephosphotransferase ["CPT1"; EC 2.7.8.2].

U.S. Pat. Appl. Pub. No. 2009-0093543-A1 describes optional co-expression of at least one gene encoding CPT1. Herein, optional co-expression of at least one gene encoding PCT is suggested. Expression of either, or both, of these enzymes will upregulate the PC biosynthetic pathway, thereby resulting in increased biosynthesis of PCs. PUFAs are esterified at the sn-2 position of PC (and other glycerophospholipids). Thus, increased expression of these enzymes may provide an additional mechanism in which PUFAs may be stored in the recombinant microbial host cell (i.e., although primary storage of PUFAs will be in the form of TAGs). The increased production of PC may also facilitate subsequent "remodeling" or "acyl editing" within the cell through the concerted action of: 1) phospholipases, such as phospholipase $A_2$, that release fatty acids from the sn-2 position of PC; and, 2) LPLATs, such as LPCAT that reacylates LPC at the sn-2 position. This facilitates removal of acyl-CoA fatty acids from the cellular acyl-CoA pool and acylation of various lysophospholipid substrates at the sn-2 position in the phospholipid pool.

Without being held to the particular theory set forth above, it may be desirable to overexpress either PCT and/or CPT1 within a recombinant host cell engineered according to the present disclosure. The gene(s) encoding PCT and/or CPT1 may be native to the host cell or heterologous. For example, in optimized strains of *Yarrowia*, it is preferred to express a *Yarrowia* PCT gene as set forth in SEQ ID NO:45 (encoding the protein of SEQ ID NO:46) and/or a *Yarrowia* CPT1 gene as set forth in SEQ ID NO:47 (encoding the protein of SEQ ID NO:48), or related enzymes sharing substantial similarity in sequence and function to SEQ ID NO:46 and/or SEQ ID NO:48.

U.S. Pat. Appl. Pub. No. 2010-0317072-A1 describes optional co-expression of at least one polynucleotide encoding malonyl CoA synthetase ["MCS"] in a recombinant host cell engineered for EPA biosynthesis. Previous studies had determined that many of the genetic mutations relating to engineering production of PUFAs in *Yarrowia lipolytica* result in increased accumulation of organic acid "byproducts" that cannot be further utilized during the microbial fermentation (with malonates accounting for ~45% of the total organic acids accumulated). In particular, U.S. Pat. Appl. Pub. No. 2010-0159558-A1 describes expression of a heterologous MCS [EC 6.2.1.-] in a recombinant strain of *Y. lipolytica* producing EPA, which catalyzed the following enzymatic reaction: malonate+ATP+CoA→malonyl-CoA+AMP+pyrophosphate (PPi). By converting the byproduct (i.e., malonate) into malonyl-CoA, this substrate became available for use during the synthesis of fatty acids within the organism. Thus, in addition to reducing the byproduction of malonates ~94% (g/g DCW), expression of the heterologous MCS also helps to avoid carbon and energy waste within the organism, reduce the amount of base required to maintain an optimal pH range during the fermentation process, and reduce the amount of byproduct organic acids that require neutralization within the fermentation waste steam. The preferred MCS was derived from *Rhizobium leguminosarum* bv. *viciae* 3841 (GenBank Accession No. YP_766603) and codon-optimized for expression in *Y. lipolytica* (i.e., SEQ ID NOs:49 and 50).

It may be desirable to express the MCS set forth as SEQ ID NOs:49 and 50, supra, or a related enzyme sharing substantial similarity in sequence and function to SEQ ID NO:50, in optimized strains of *Yarrowia* or other recombinant host cells that are engineered according to the present disclosure.

Another gene that may optionally be expressed in the recombinant microbial host cells described herein is a delta-9 desaturase. As will be apparent to one of skill in the art, overexpression of this particular enzyme will increase the conversion of stearic acid [18:0] to oleic acid [18:1], thereby resulting in greater "pushing" of carbon into the PUFA biosynthetic pathway.

The recombinant microbial host cell described herein may further comprise at least one mutant delta-5 desaturase. Along with delta-6, delta-8 and delta-4 desaturases, delta-5 desaturases are known as long-chain PUFA "front-end" desaturases (wherein desaturation occurs between a pre-existing double bond and the carboxyl terminus of the fatty acid's acyl group, as opposed to methyl-directed desaturation). These desaturases are characterized by three H is boxes [$H(X)_{3-4}H$ (SEQ ID NOs:186 and 187), $H(X)_{2-3}HH$ (SEQ ID NOs:188 and 189) and $H/Q(X)_{2-3}HH$ (SEQ ID NOs:190 and 191)] and are members of the cytochrome $b_5$ fusion superfamily, since they possess a fused cytochrome $b_5$ domain at their N-terminus which serves as an electron donor. The cytochrome $b_5$ domain also contains a conserved heme-binding motif (i.e., a HPGG sequence [SEQ ID NO:181]), despite divergence of the remaining cytochrome $b_5$ domain sequences. An additional conserved signature motif previously identified as characteristic of delta-5 desaturases also appears to be rich in histidine (i.e., a HDASH sequence [SEQ ID NO:183]), although the importance of the HDASH motif to enzymatic activity has yet to be elucidated.

In some embodiments of the present invention, the at least one mutant delta-5 desaturase may be selected from the group consisting of:
  a) a mutant polypeptide comprising: an amino acid motif as set forth in SEQ ID NO:180 [HxGx], wherein SEQ ID NO:180 [HxGx] is not identical to SEQ ID NO:181 [HPGG]; and, an amino acid motif as set forth in SEQ ID NO:182 [HxxxH] wherein SEQ ID NO:182 [HxxxH] is not identical to SEQ ID NO:183 [HDASH];
  b) a mutant polypeptide having the amino acid sequence selected from the group consisting of: SEQ ID NO:106 [EgD5M or codon-optimized EgD5R*-34g158g], SEQ ID NO:108 [EgD5R*-34g158g347s], SEQ ID NO:110 [EgD5S-36s157g], SEQ ID NO:112 [EaD5S-35a158g], SEQ ID NO:299 [EgD5R*-34g157g], SEQ ID NO:301 [EgD5R*-34g158a], SEQ ID NO:303 [EgD5R*-34g158g], SEQ ID NO:329 [EgD5S-36s156e], SEQ ID NO:331 [EgD5S-36s158a], SEQ ID NO:333 [EgD5S-36s158g], SEQ ID NO:363 [EaD5S-35a158s], SEQ ID NO:365 [EaD5S-35a159g].

The recombinant microbial host cells described herein will be capable of producing a microbial oil comprising at least about 25 EPA % DCW, preferably at least about 25-30 EPA % DCW, more preferably at least about 30-32.5 EPA % DCW more preferably at least about 32.5-35 EPA % DCW, and most preferably at least about 35-40 EPA % DCW. As one of skill in the art of fermentation will appreciate, variability will occur in the oil profile of a specific recombinant microbial host cell, depending on the fermentation run itself, media conditions, process parameters, scale-up, etc., as well as the particular time-point in which the culture is sampled. Thus, a particular recombinant microbial host having a specified genotype may be capable of producing a microbial oil comprising at least about 25 EPA % DCW when cultured under optimal conditions, but will not always produce a microbial oil comprising at least about 25 EPA % DCW (e.g., when the length of fermentation is insufficient). The present discussion therefore refers to the "capability" of the organism to produce at least about 25 EPA % DCW, when cultured under suitable conditions.

As will be clear to one of skill in the art, a multitude of different optimized recombinant strains capable of producing at least about 25 EPA % DCW could be engineered using the methodologies described herein. Selection of a preferred strain for commercial purposes will consider both the concentration of EPA as a percent of the total fatty acids ["EPA % TFAs"] and total lipid content ["TFAs % DCW"], as both factors affect the cellular content of EPA as a percent of the dry cell weight ["EPA % DCW"]. That is, EPA % DCW is calculated as: (EPA % TFAs)*(TFAs DCW)]/100. For example, a strain producing 40 EPA % TFAs and having 62.5 TFAs % DCW, a strain producing 45 EPA % TFAs and having 55.55 TFAs % DCW, a strain producing 50 EPA % TFAs and having 50 TFAs DCW, a strain producing 55 EPA % TFAs and having 45.45 TFAs % DCW, a strain producing 60 EPA % TFAs and having 41.67 TFAs % DCW and a strain producing 65 EPA % TFAs and having 38.46 TFAs % DCW all produce 25 EPA % DCW.

In preferred embodiments, the improved recombinant microbial host cells will be capable of producing an oil comprising at least 25 EPA DCW and will produce at least 45 EPA % TFAs. More preferably, the oil will comprise at least about 47-50 EPA % TFAs, preferably at least about 50-55 EPA % TFAs, more preferably at least about 55-60 EPA % TFAs, more preferably at least 60-70 EPA % TFAs, and most preferably at least about 70-80 EPA % TFAs.

In another embodiment, the improved recombinant microbial host cells will be capable of producing an oil comprising at least 25 EPA % DCW and the lipid profile within the improved recombinant microbial host cells, or within extracted or unconcentrated oil therefrom, will have a ratio of EPA % TFAs to LA % TFAs of at least about 2.4. As previously discussed in U.S. Pat. Appl. Pub. No. 2009-0093543-A1, minimizing the concentration of the intermediate fatty acid, LA (resulting in increased ratios of EPA:LA), will result in greater "pushing" of the carbon through the PUFA biosynthetic pathway and permit increased synthesis of EPA. In preferred embodiments, the ratio of EPA:LA will be at least about 2.4-2.75, more preferably at least about 2.75-3.25, more preferably at least about 3.25-4, and most preferably at least about 4-5.5.

A variety of microbial host cells naturally produce microbial oils, including various bacteria, yeast, algae, euglenoids, stramenopiles, fungi, and mixtures thereof. And, EPA can be produced microbially via numerous different processes based on the natural abilities of the specific microbial organism utilized [e.g., heterotrophic diatoms *Cyclotella* sp. and *Nitzschia* sp. (U.S. Pat. No. 5,244,921); *Pseudomonas, Alteromonas* or *Shewanella* species (U.S. Pat. No. 5,246,841); filamentous fungi of the genus *Pythium* (U.S. Pat. No. 5,246,842); or *Mortierella elongata, M. exigua*, or *M. hygrophila* (U.S. Pat. No. 5,401,646)]. A useful review describing microorganisms naturally producing EPA is that of Z. Wen and F. Chen, In *Single Cell Oils*; C. Ratledge and Z. Cohen, Eds.; AOCS Publishing, 2005; Chapter 10, entitled "Prospects for EPA production using microorganisms".

For the purposes herein, the recombinant microbial host cells should be cells which can be genetically manipulated via tools of genetic engineering, and be capable of producing a microbial oil comprising at least 25 EPA % DCW.

A microbe lacking the natural ability to make EPA can be engineered to express a PUFA biosynthetic pathway by introduction of appropriate PUFA biosynthetic pathway genes, such as specific combinations of delta-5 desaturases, delta-6 desaturases, delta-12 desaturases, delta-15 desaturases, delta-17 desaturases, delta-9 desaturases, delta-8 desaturases, delta-9 elongases, $C_{14/16}$ elongases, $C_{16/18}$ elongases and $C_{18/20}$ elongases, although it is to be recognized that the specific enzymes (and genes encoding those enzymes) introduced are by no means limiting to the invention herein. For example, public and patent literature teaches means to engineer the following for EPA biosynthesis (albeit at low levels of production): *Escherichia coli* (Orikasa, A. et al., *Cell Mol. Biol.* 50:625-630 (2004)), *Saccharomyces cereviasiae* (Tavares, S., et al., AEM, 77(5)1854-1861 (2011).

In preferred embodiments, the microbial host cells are oleaginous, such that they accumulate in excess of about 25% of their DCW as oil. The oleaginous microbial host cells may be e.g., a member of a genus selected from the group consisting of *Mortierella, Thraustochytrium, Schizochytrium* and oleaginous yeast. Oleaginous yeast are capable of oil synthesis and accumulation, wherein the total oil content can comprise greater than about 25% of the DCW, more preferably greater than about 30% of the DCW, and most preferably greater than about 40% of the DCW. In alternate embodiments, a non-oleaginous yeast can be genetically modified to become oleaginous such that it can produce more than 25% oil of the DCW, e.g., yeast such as *Saccharomyces cerevisiae* (Intl App. Pub. No. WO 2006/102342).

Genera typically identified as oleaginous yeast include, but are not limited to: *Yarrowia, Candida, Rhodotorula, Rhodosporidium, Cryptococcus, Trichosporon* and *Lipomyces*. More specifically, illustrative oil-synthesizing yeasts include: *Rhodosporidium toruloides, Lipomyces starkeyii, L. lipoferus, Candida revkaufi, C. pulcherrima, C. tropicalis, C. utilis, Trichosporon pullans, T. cutaneum, Rhodotorula glutinus, R. graminis*, and *Yarrowia lipolytica* (formerly classified as *Candida lipolytica*).

Most preferred is the oleaginous yeast *Yarrowia lipolytica*; and, in a further embodiment, most preferred are the *Y. lipolytica* strains designated as ATCC #20362, ATCC #8862, ATCC #18944, ATCC #76982 and/or LGAM S(7)1 (Papanikolaou S., and Aggelis G., *Bioresour. Technol.* 82(1):43-9 (2002)).

Any of the above mentioned genera may be suitable for recombinant engineering, according to the disclosure herein, to produce host cells capable of producing a microbial oil comprising at least 25 EPA % DCW. Thus, it will be apparent that genetic manipulation is not limited to the introduction or up-regulation of an appropriate PUFA biosynthetic pathway; instead, the host organism may be further manipulated genetically to modify the total lipid accumulated, modify glycerophospholipid biosynthesis, modify carbon flow through the cell, modify pathways that result (directly or indirectly) in PUFA degradation, etc.

It is noted that the structural form of the EPA is not limiting; thus, for example, EPA may exist in the total lipids as FFAs or in esterified forms. Preferably, the at least one PUFA is in the form of TAGs.

Although numerous recombinant microbial host cells could be engineered for production of EPA according to the disclosure herein, the present invention has been demonstrated in *Yarrowia lipolytica*. One of skill in the art will appreciate, however, that the methodology of the present invention is not limited to the use of the species or genus in which the invention has been demonstrated. Instead, any oleaginous yeast or any other suitable microbe capable of producing microbial oils comprising at least 25 EPA % DCW will be equally suitable for use in the present methodologies.

Microbial expression systems and expression vectors containing regulatory sequences that direct high-level expression of foreign genes are well known to those skilled in the art. Any of these could be used to construct chimeric genes encoding the preferred desaturase, elongase, DGLA synthase, LPAAT, PDAT, PCT, CPT1, and MCS proteins. These chimeric genes could then be introduced into the microbial host cells using standard methods of transformation to provide high-level expression of the encoded enzymes.

Vectors (e.g., constructs, plasmids) and DNA expression cassettes useful for the transformation of microbial host cells are well known in the art. The specific choice of sequences present in the construct is dependent upon the desired expression products, the nature of the host cell, and the proposed means of separating transformed cells versus non-transformed cells. Typically, however, the vector contains at least one expression cassette, a selectable marker and sequences allowing autonomous replication or chromosomal integration. Suitable expression cassettes typically comprise a promoter, the coding sequence of a selected gene, and a terminator. It is most preferred when both control regions are derived from genes from the transformed host cell.

Where two or more genes are expressed from separate replicating vectors, it is desirable that each vector has a different means of selection and should lack homology to the other constructs to maintain stable expression and prevent reassortment of elements among constructs. Judicious choice of regulatory regions, selection means and method of propagation of the introduced construct can be experimentally determined so that all introduced genes are expressed at the necessary levels to provide for synthesis of the desired products.

Constructs or vectors comprising the gene(s) of interest may be introduced into a host cell by any standard technique. These techniques include transformation (e.g., lithium acetate transformation [*Methods in Enzymology*, 194:186-187 (1991)]), bolistic impact, electroporation, microinjection, or any other method that introduces the gene(s) of interest into the host cell. As an example, U.S. Pat. No. 4,880,741 and No. 5,071,764 and Chen, D. C. et al. (*Appl. Microbiol. Biotechnol.*, 48(2):232-235 (1997)) describe integration techniques for *Yarrowia lipolytica*, based on linearized fragments of DNA.

For convenience, a host cell that has been manipulated by any method to take up a DNA sequence (e.g., an expression cassette) is referred to herein as "transformed", "transformant" or "recombinant". The transformed host will have at least one copy of the expression cassette and may have two or more, depending upon whether the expression cassette is integrated into the genome or is present on an extrachromosomal element having multiple copy numbers. The transformed host cell can be identified by various selection techniques, as described in U.S. Pat. No. 7,238,482 and U.S. Pat. No. 7,259,255.

Preferred selection methods for use herein are resistance to kanamycin, hygromycin and the amino glycoside G418, as well as ability to grow on media lacking uracil, leucine, lysine, tryptophan or histidine. In alternate embodiments, 5-fluoroorotic acid (5-fluorouracil-6-carboxylic acid monohydrate; "5-FOA") is used for selection of yeast Ura– mutants (U.S. Pat. Appl. Pub. No. 2009-0093543-A1), or a native acetohydroxyacid synthase (or acetolactate synthase; E.C. 4.1.3.18) that confers sulfonyl urea herbicide resistance (Intl. App. Pub. No. WO 2006/052870) is utilized for selection of transformants. A unique method of "recycling" a pair of preferred selection markers for their use in multiple sequential transformations, by use of site-specific recombinase systems, is also taught in U.S. Pat. Appl. Pub. No. 2009-0093543-A1.

As is well known to one of skill in the art, merely inserting a gene (e.g., desaturase, elongase, DGLA synthase, LPAAT, PDAT, PCT, CPT1, MCS) into a cloning vector does not ensure its expression at the desired rate, concentration, amount, etc. It may be desirable to manipulate a number of different genetic elements that control aspects of transcription, RNA stability, translation, protein stability and protein location, oxygen limitation and secretion from the host cell. More specifically, gene expression may be controlled by altering the following: the nature of the relevant promoter and terminator sequences; the number of copies of the cloned gene; whether the gene is plasmid-borne or integrated into the genome of the host cell; the final cellular location of the synthesized foreign protein; the efficiency of translation in the host organism; the intrinsic stability of the cloned gene protein within the host cell; and, the codon usage within the cloned gene, such that its frequency approaches the frequency of preferred codon usage of the host cell. Several of these methods of overexpression will be discussed below, and are useful during genetic manipulation of recombinant microbial host cells as a means to overexpress genes encoding e.g., desaturase, elongase, DGLA synthase, LPAAT, PDAT, PCT, CPT1, and MCS.

Expression of the desired gene(s) can be increased at the transcriptional level through the use of a stronger promoter (either regulated or constitutive) to cause increased expression, by removing/deleting destabilizing sequences from either the mRNA or the encoded protein, or by adding stabilizing sequences to the mRNA (U.S. Pat. No. 4,910,141).

Promoters useful to drive expression of heterologous genes in microbial host cells are numerous and known to those skilled in the art. Expression can be accomplished in an induced or constitutive fashion. Induced expression can be accomplished by inducing the activity of a regulatable promoter operably linked to the gene of interest, while constitutive expression can be achieved by the use of a constitutive promoter operably linked to the gene of interest. Virtually any promoter (i.e., native, synthetic, or chimeric) capable of directing expression of desaturase, elongase, DGLA synthase, LPAAT, PDAT, PCT, CPT1, and MCS genes will be suitable, although transcriptional and translational regions from the host species are particularly useful.

In general, the terminator can be derived from the 3' region of the gene from which the promoter was obtained or from a different gene. A large number of terminators are known and function satisfactorily in a variety of hosts, when utilized both in the same and different genera and species from which they were derived. The terminator usually is selected more as a matter of convenience rather than because of any particular property. Preferably, the terminator is derived from a yeast gene. The terminator can also be synthetic, as one of skill in the art can utilize available information to design and synthesize a terminator. A terminator may be unnecessary, but it is highly preferred.

Although not intended to be limiting, preferred promoters and terminators for use in a recombinant microbial host cell of the genus *Yarrowia* are those taught in U.S. Pat. Pub. No. 2009-0093543-A1, U.S. Pat. Pub. No. 2010-0068789-A1, U.S. Pat. Pub. No. 2011-0059496-A1, U.S. Provisional Pat. Appl. No. 61/469,933 (filed Mar. 31, 2011), U.S. Provisional Pat. Appl. No. 61/470,539 (filed Apr. 1, 2011), U.S. Provisional Pat. Appl. No. 61/471,736 (filed Apr. 5, 2011), and U.S. Provisional Pat. Appl. No. 61/472,742 (filed Apr. 7, 2011), the disclosure of each which is hereby incorporated herein by reference.

Additional copies (i.e., more than one copy) of the PUFA biosynthetic pathway desaturases, elongases, DGLA synthase, LPAAT, PDAT, PCT, CPT1, and MCS genes may be introduced into the recombinant microbial host cell to thereby increase EPA production and accumulation. Specifically, additional copies of genes may be cloned within a single expression construct; and/or, additional copies of the cloned gene(s) may be introduced into the host cell by increasing the plasmid copy number or by multiple integration of the cloned gene into the genome (infra).

It is important to note that when preparing an optimized recombinant microbial host cell according to the methodology herein, copies of various desaturases, elongases, DGLA synthases, LPAATs, PDATs, PCTs, CPT1s, and MCSs are often referred to. If, for example, 2 copies of a delta-9 elongase are required, this can refer to: 1) two copies of an identical coding sequence for a particular delta-9 elongase isolated from a single species; or, 2) one coding sequence for a delta-9 elongase isolated from a species "A" and one coding sequence for a delta-9 elongase isolated from a species "B", thus collectively resulting in two delta-9 elongases.

In general, once a DNA cassette (e.g., comprising a chimeric gene comprising a promoter, ORF and terminator) suitable for expression in an recombinant microbial host cell has been obtained, it is either placed in a plasmid vector capable of autonomous replication in a host cell or directly integrated into the genome of the host cell. Integration of expression cassettes can occur randomly within the host genome or can be targeted through the use of constructs containing regions of homology with the host genome sufficient to target recombination with the host locus. Although not relied on herein, all or some of the transcriptional and translational regulatory regions can be provided by the endogenous locus where constructs are targeted to an endogenous locus.

With respect to engineered recombinant *Yarrowia lipolytica* host cells, the preferred method of expressing genes in this microbial host is by integration of a linear DNA fragment into the genome of the host. Integration into multiple locations within the genome can be particularly useful when high level expression of genes are desired. Preferred loci include those taught in U.S. Pat. Pub. No. 2009-0093543-A1.

Furthermore, Juretzek et al. (Yeast, 18:97-113 (2001)) note that the stability of an integrated DNA fragment in *Yarrowia lipolytica* is dependent on the individual transformants, the recipient strain and the targeting platform used. Thus, the skilled artisan will recognize that multiple transformants of a particular recombinant microbial host must be screened in order to obtain a strain displaying the desired expression level and pattern. Such screening may be accomplished by Southern analysis of DNA blots (Southern, *J. Mol. Biol.*, 98:503 (1975)), Northern analysis of mRNA expression (Kroczek, *J. Chromatogr. Biomed. Appl.*, 618 (1-2):133-145 (1993)), Western analysis of protein expression, phenotypic analysis or GC analysis of the PUFA products.

The transformed recombinant microbial host cells of the present disclosure are grown under conditions that optimize expression of chimeric genes (e.g., encoding desaturases, elongases, DGLA synthases, LPAATs, PDATs, PCTs, CPT1s, and MCSs) and produce the greatest and the most economical yield of EPA. In general, media conditions may be optimized by modifying the type and amount of carbon source, the type and amount of nitrogen source, the carbon-to-nitrogen ratio, the amount of different mineral ions, the oxygen level, growth temperature, pH, length of the biomass production phase, length of the oil accumulation phase and the time and method of cell harvest. For example, *Yarrowia lipolytica* are generally grown in a complex media such as yeast extract-peptone-dextrose broth ["YPD"] or a defined minimal media that lacks a component necessary for growth and thereby forces selection of the desired expression cassettes (e.g., Yeast Nitrogen Base (DIFCO Laboratories, Detroit, Mich.)).

Fermentation media for the methods and host cells described herein must contain a suitable carbon source, such as are taught in U.S. Pat. No. 7,238,482 and U.S. Pat. Pub. No. 2011-0059204-A1. Although it is contemplated that the source of carbon utilized in the present invention may encompass a wide variety of carbon-containing sources, preferred carbon sources are sugars (e.g., glucose, invert sucrose, fructose and combinations of thereof), glycerols and/or fatty acids (e.g., those containing between 10-22 carbons).

Nitrogen may be supplied from an inorganic (e.g., $(NH_4)_2SO_4$) or organic (e.g., urea or glutamate) source. In addition to appropriate carbon and nitrogen sources, the fermentation media must also contain suitable minerals, salts, cofactors, buffers, vitamins and other components known to those skilled in the art suitable for the growth of the recombinant microbial host cell and the promotion of the enzymatic pathways for EPA production. Particular attention is given to several metal ions, such as $Fe^{+2}$, $Cu^{+2}$, $Mn^{+2}$, $Co^{+2}$, $Zn^{+2}$ and Mg$^{+2}$, that promote synthesis of lipids and PUFAs (Nakahara, T. et al., *Ind. Appl. Single Cell Oils*, D. J. Kyle and R. Colin, eds. pp 61-97 (1992)).

Preferred growth media for the methods and host cells described herein are common commercially prepared media, such as Yeast Nitrogen Base (DIFCO Laboratories, Detroit, Mich.). Other defined or synthetic growth media may also be used and the appropriate medium for growth of e.g., *Yarrowia lipolytica* will be known by one skilled in the art of microbiology or fermentation science. A suitable pH range for the fermentation is typically between about pH 4.0 to pH 8.0, wherein pH 5.5 to pH 7.5 is preferred as the range for the initial growth conditions. The fermentation may be conducted under aerobic or anaerobic conditions, wherein microaerobic conditions are preferred.

Typically, accumulation of high levels of PUFAs in oleaginous yeast cells requires a two-stage process, since the metabolic state must be "balanced" between growth and synthesis/storage of fats. Thus, most preferably, a two-stage fermentation process is necessary for the production of EPA in *Yarrowia lipolytica*. This approach is described in U.S. Pat. No. 7,238,482, as are various suitable fermentation process designs (i.e., batch, fed-batch and continuous) and considerations during growth.

Example 10 of U.S. Pat. Appl. Pub. No. 2009-0093543-A1 also provides a detailed description of parameters required for a 2-L fermentation of the recombinant *Yarrowia lipolytica* strain Y4305 (whose maximum production was 12.1 EPA % DCW [i.e., 55.6 EPA % TFAs, with a ratio of EPA % TFAs to LA % TFAs of 3.03], over a period of 162 hours). This disclosure includes a description of means to prepare inocula from frozen cultures to generate a seed culture, initially culture the yeast under conditions that promoted rapid growth to a high cell density, and then culture the yeast to promote lipid and PUFA accumulation (via starving for nitrogen and continuously feeding glucose). Process variables including temperature (controlled between 30-32° C.), pH (controlled between 5-7), dissolved oxygen concentration and glucose concentration were monitored and controlled per standard operating conditions to ensure consistent process performance and final PUFA oil quality.

Figure 2:
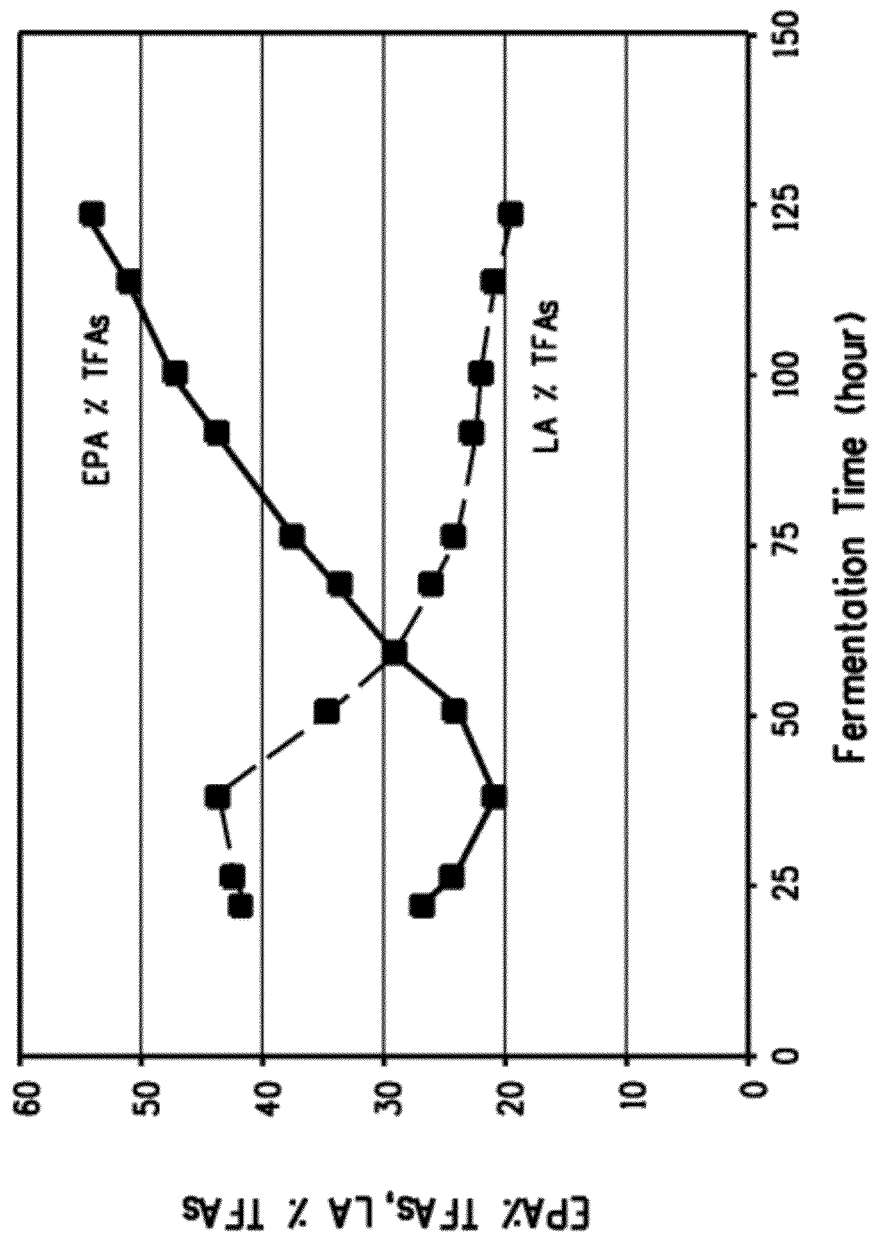

In particular, the data of Example 10 of U.S. Pat. Appl. Pub. No. 2009-0093543-A1 can be utilized to generate a graph demonstrating how EPA % TFAs and LA % TFAs vary over the course of the fermentation, as shown in FIG. 2 herein and summarized in Table 6 below.

TABLE 6

Relationship Between EPA % TFAs And LA % TFAs Over The Course Of Fermentation

| Fermentation Time | EPA % TFAs | LA % TFAs | EPA:LA Ratio | EPA % of DCW |
|---|---|---|---|---|
| 68.3 | 33.2 | 26.6 | 1.25 | 6.18 |
| 99.7 | 46.9 | 22.6 | 2.08 | 10.18 |
| 123.7 | 53.6 | 19.7 | 2.72 | 11.68 |

In particular, it should be noted that EPA % TFAs increased during hours ~40-125 of the fermentation, LA % TFAs decreased during hours ~40-125 of the fermentation and the EPA:LA ratio increased. It is clear from this analysis that whilst *Yarrowia lipolytica* strain Y4305 was capable of producing 12.1 EPA % DCW, the oil profile of the recombinant microbial host cell will depend on the fermentation run itself, media conditions, process parameters, scale-up, etc., as well as the particular time-point in which the culture is sampled.

Thus, the engineered strain was capable of producing microbial oil having a variety of different lipid contents and compositions (i.e., based on EPA % TFAs, LA % TFAs and EPA:LA ratio).

These factors must also be considered when culturing the recombinant microbial host cells described herein, to realize the full potential of the engineered host cells and achieve at least 25 EPA % DCW in any particular fermentation run.

In some aspects herein, the primary product is the recombinant microbial biomass. As such, isolation and purification of the EPA-containing oils from the microbial biomass may not be necessary (i.e., wherein the whole cell biomass is the product). However, certain end uses and/or product forms may require partial and/or complete isolation/purification of the EPA-containing oil from the microbial biomass, to result in partially purified microbial biomass, purified oil, and/or purified EPA. See U.S. Pat. Appl. Pub. No. 2010-0317072-A1 for further details regarding these aspects.

Oils containing EPA that have been refined and/or purified can be hydrogenated, to thereby result in fats with various melting properties and textures. Many processed fats, including spreads, confectionary fats, hard butters, margarines, baking shortenings, etc., require varying degrees of solidity at room temperature and can only be produced through alteration of the source oil's physical properties. This is most commonly achieved through catalytic hydrogenation (see Intl. App. Pub. No. WO 2006/052870 for additional details and references).

Food products, infant formulas, functional foods, medical foods, medical nutritionals, dietary supplements, pharmaceutical compositions, animal feeds, and personal care products comprising oleaginous yeast biomass comprising EPA are taught in U.S. Pat. Appl. Pub. No. 2010-0317072-A1 and these uses are equally applicable herein, for either the recombinant microbial biomass comprising EPA itself, or microbial oil comprising EPA isolated therefrom.

One of skill in the art of processing and formulation will understand how the amount and composition of the recombinant microbial biomass, partially purified biomass, purified oil, and/or purified EPA may be added to a particular product according to target species and/or end use. More specifically, an "effective" amount should be incorporated into a product formulation, although this amount will depend on the food or feed product, the diet that the product is intended to supplement or the medical condition that the medical food or medical nutritional is intended to correct or treat.

Most desirably, the effective amount of EPA will be sufficient to provide the desirable health characteristics associated with omega-3/omega-6 PUFA consumption. Typically, the amount of EPA incorporated into the product takes into account losses associated with processing conditions, typical handling and storage conditions, the stability of EPA in the product, and the bioavailability/bioabsorption efficiency with the target species, to name a few.

One of skill in the art of processing and formulation will be familiar with processes to concentrate the microbial oil produced from the recombinant microbial host cells described herein, to thereby increase the concentration of EPA in the total lipid fraction such that it comprises at least about 55-60%, at least about 60-65%, at least about 65-70%, at least about 70-85%, at least about 85-90%, at least about 90-95% EPA or even 95-99% EPA. Means to blend the purified oils described herein with other purified fatty acids (e.g., LA, GLA, EDA, DGLA, ARA, DTA, DPAn-6, ALA, STA, ETrA, ETA, DPA and DHA), or oils containing alternate fatty acids in preferred concentrations, are also well known to one of skill in the art. These techniques readily permit the creation of an oil comprising a uniquely tailored fatty acid profile.

DESCRIPTION OF PREFERRED EMBODIMENTS

Various recombinant strains of the oleaginous yeast *Yarrowia lipolytica* are demonstrated herein to produce greater than 25 EPA % DCW, as elaborated in the below Examples. Table 7 provides a summary of some of these recombinant strains, with respect to recombinant *Yarrowia lipolytica* strain Z1978 (previously engineered to produce 22.5 EPA % DCW), based on genotype, total lipid content and lipid composition, as determined by flask assays.

pared to strain Z1978; strain L258 was transformed with two additional expression cassettes comprising YILPAAT1 and two additional expression cassettes comprising YIPDAT, when compared to strain Z1978.

The Table summarizes the total dry cell weight of the cells ["DCW"], the total lipid content of cells ["TFAs % DCW"], the concentration of each fatty acid as a weight percent of TFAs ["% TFAs"], the EPA content as a percent of the dry cell weight ["EPA % DCW"] and the ratio of EPA TFAs to LA % TFAs ["EPA:LA ratio"]. Fatty acids are 16:0 (palmitate), 16:1 (palmitoleic acid), 18:0 (stearic acid), 18:1 (oleic acid), 18:2 (linoleic acid), ALA (alpha-linolenic acid), EDA (eicosadienoic acid), DGLA (dihomo-gamma-linolenic acid), ARA (arachidonic acid), ETrA (eicosatrienoic acid), ETA (eicosatetraenoic acid), EPA (eicosapentaenoic acid) and other.

TABLE 7

Total Lipid Content And Composition In Various Recombinant *Yarrowia lipolytica* Strains By Flask Assay

| Strain | DCW (g/L) | TFAs % DCW | 16:0 | 16:1 | 18:0 | 18:1 | 18:2 | ALA | % TFAs EDA | DGLA | ARA | EtrA | ETA | EPA | other | EPA % DCW | EPA:LA Ratio |
|---|---|---|---|---|---|---|---|---|---|---|---|---|---|---|---|---|---|
| Z1977 | 3.8 | 34.3 | 2 | 0.5 | 1.9 | 4.6 | 11.2 | 0.7 | 3.1 | 3.3 | 0.9 | 0.7 | 2.2 | 59.1 | 9.9 | 20.3 | 5.28 |
| Z1978 | 3.9 | 38.3 | 2.4 | 0.4 | 2.4 | 4.8 | 11.1 | 0.7 | 3.2 | 3.3 | 0.8 | 0.6 | 2.1 | 58.7 | 9.5 | 22.5 | 5.29 |
| Z1979 | 3.7 | 33.7 | 2.3 | 0.4 | 2.4 | 4.1 | 10.5 | 0.6 | 3.2 | 3.6 | 0.9 | 0.6 | 2.2 | 59.4 | 9.8 | 20 | 5.66 |
| Z1980 | 3.6 | 32.7 | 2.1 | 0.4 | 2.2 | 4 | 10.8 | 0.6 | 3.1 | 3.5 | 0.9 | 0.7 | 2.2 | 59.5 | 10 | 19.5 | 5.51 |
| Z1981 | 3.5 | 34.3 | 2.2 | 0.4 | 2.1 | 4.2 | 10.6 | 0.6 | 3.3 | 3.4 | 1 | 0.8 | 2.2 | 58.5 | 10.7 | 20.1 | 5.52 |
| Genotype Additions with Respect to Strain Z1978: YILPAAT1, YIPDAT ||||||||||||||||||
| L250 | 4.4 | 51.5 | 2 | 0.7 | 2.8 | 6.1 | 16.7 | 0.9 | 3.3 | 4.9 | 0.7 | 0.6 | 3.2 | 50.4 | 7.4 | 26 | 3.02 |
| Genotype Additions with Respect to Strain Z1978: 2 YILPAAT1, 2 YIPDAT ||||||||||||||||||
| L258 | 5 | 57.1 | 2.3 | 0.9 | 3.4 | 7.8 | 18.7 | 0.9 | 4 | 5.3 | 0.8 | 0.6 | 3.2 | 45.2 | 6.6 | 25.8 | 2.42 |
| Genotype Additions with Respect to Strain Z1978: EgD8M, MCS, MaLPAAT1S, 2 YILPAAT1, 2 YIPDAT ||||||||||||||||||
| Z5565 | 4.8 | 56.1 | 2.1 | 0.8 | 2.8 | 6.8 | 17.3 | 0.8 | 3.8 | 5.2 | 1.1 | 0.8 | 3.4 | 47.4 | 7.1 | 26.6 | 2.74 |
| Z5567 | 4.9 | 56.2 | 1.9 | 0.7 | 2.6 | 6.2 | 16.7 | 0.7 | 3.8 | 5.6 | 1.1 | 1 | 3.6 | 48.3 | 7.2 | 27.1 | 2.89 |
| Z5575 | 4.7 | 53.8 | 1.8 | 0.7 | 2.4 | 5.7 | 15.3 | 0.6 | 3.6 | 5.9 | 1.2 | 1 | 3.6 | 50.4 | 7.4 | 27.1 | 3.29 |
| Z5576 | 4.9 | 55.6 | 2.3 | 0.9 | 2.8 | 6.9 | 16.9 | 0.7 | 3.6 | 5.5 | 1.2 | 0.9 | 3.3 | 47.2 | 7.4 | 26.2 | 2.79 |
| Genotype Additions with Respect to Strain Z1978: EgD8M, MCS, 3 YILPAAT1, 2 YIPDAT ||||||||||||||||||
| Z5620 | 4.5 | 52.8 | 2.1 | 0.7 | 2.8 | 6.6 | 16.1 | 0.7 | 3.6 | 5.7 | 1.1 | 0.7 | 3.3 | 49 | 6.9 | 25.9 | 3.04 |
| Z5623 | 4.3 | 51.7 | 2.3 | 0.8 | 2.4 | 6 | 15.9 | 0.7 | 3.8 | 5.2 | 1.1 | 0.7 | 3.1 | 50 | 7.3 | 25.8 | 3.14 |
| Z5625 | 4.6 | 52.7 | 2.1 | 0.7 | 2.7 | 6.2 | 16.6 | 0.7 | 3.9 | 5.4 | 1.1 | 0.8 | 3.2 | 49.1 | 6.8 | 25.9 | 2.96 |
| Genotype Additions with Respect to Strain Z1978: ME3S, MCS, MaLPAAT1S, 2 YILPAAT1, 2 YIPDAT ||||||||||||||||||
| Z5581 | 4.7 | 56.3 | 1.9 | 0.7 | 2.6 | 6.1 | 16.5 | 0.7 | 3.7 | 5.6 | 1.2 | 1 | 3.5 | 48.7 | 7.2 | 27.4 | 2.95 |
| Z5582 | 4.8 | 55.6 | 1.9 | 0.7 | 2.5 | 6.1 | 16.4 | 0.7 | 3.7 | 5.7 | 1.1 | 0.9 | 3.6 | 48.9 | 7.2 | 27.2 | 2.98 |
| Z5583 | 4.9 | 56.8 | 2 | 0.7 | 2.6 | 6.2 | 16.7 | 0.8 | 3.7 | 5.4 | 1 | 1 | 3.7 | 48.4 | 7.2 | 27.5 | 2.90 |
| Z5584 | 4.9 | 55.3 | 2 | 0.7 | 2.7 | 6.5 | 16.1 | 0.7 | 3.7 | 5.7 | 1.1 | 1 | 3.6 | 48.6 | 7.1 | 26.8 | 3.02 |
| Genotype Additions with Respect to Strain Z1978: YIPCT, YID9, MaLPAAT1S, 2 YILPAAT1, 2 YIPDAT ||||||||||||||||||
| Z5570 | 4.8 | 55 | 2 | 0.8 | 2.5 | 6.1 | 16.4 | 0.7 | 3.7 | 5.5 | 1.2 | 1 | 3.4 | 48.6 | 7.4 | 26.8 | 2.96 |
| Z5571 | 4.8 | 54.1 | 2.2 | 0.8 | 2.4 | 6.5 | 16.7 | 0.7 | 3.8 | 5.5 | 1.1 | 0.9 | 3.2 | 48.3 | 7.2 | 26.2 | 2.89 |
| Z5572 | 4.9 | 54 | 2.1 | 0.8 | 2.5 | 6.5 | 16.7 | 0.7 | 3.7 | 5.5 | 1.1 | 0.9 | 3.3 | 48.4 | 7.2 | 26.1 | 2.90 |
| Z5574 | 5 | 53.8 | 1.8 | 0.7 | 2.4 | 5.7 | 15.3 | 0.6 | 3.6 | 5.9 | 1.2 | 1 | 3.6 | 50.4 | 7.4 | 27.1 | 3.29 |
| Genotype Additions with Respect to Strain Z1978: YICPT1, YID9, MaLPAAT1S, 2 YILPAAT1, 2 YIPDAT ||||||||||||||||||
| Z5585 | 4.6 | 56.6 | 1.9 | 0.7 | 2.6 | 5.6 | 16.4 | 0.7 | 3.5 | 5.5 | 1.1 | 1 | 3.5 | 49.4 | 7.3 | 28 | 3.01 |
| Z5627 | 4.8 | 52 | 1.9 | 0.7 | 2.6 | 6.2 | 16.1 | 0.6 | 4 | 5.6 | 1.2 | 0.9 | 3.2 | 49.3 | 6.9 | 25.6 | 3.06 |

Each block within the table represents a strain or strains produced within a single transformation (i.e., strains Z1977, Z1978, Z1979, Z1980 and Z1981 were individual colonies from a single transformation) and thus are expected to share the same genotype. The genotype of those strains derived from strain Z1978 are summarized with respect to the genotype of strain Z1978, using a short-hand notation which highlights additional genes that are expressed within the transformant, as well as the copy number of these genes. Thus, for example, strain L250 was transformed with one additional expression cassette comprising YILPAAT1 and one additional expression cassette comprising YIPDAT, when com- Within those strains comprising at least two polypeptides having at least LPAAT activity and at least one polypeptide having at least PDAT activity, the EPA % DCW ranges from 25.6 to 28, the EPA % TFAs ranges from 45.2 to 50.4 and the ratio of EPA % TFAs to LA % TFAs ("EPA:LA Ratio") ranges from 2.42 to 3.29.

It is worth noting that while all of these strains produced more than 25 EPA % DCW, the same strains may be used to produce less than 25 EPA % DCW by shortening the total fermentation time. Similar to the performance of recombinant *Yarrowia lipolytica* strain Y4305 discussed above with respect to FIG. 2, these strains of Table 7 would be expected to produce less EPA % TFAs, more LA % TFAs, and have a decreased EPA:LA ratio if the fermentation time were shorted. Thus, one of ordinary skill in the art will appreciate that these engineered *Y. lipolytica* strains are capable of producing microbial oils having a variety of concentrations of EPA with various EPA:LA ratios, according to the particular sampling time point within the fermentation.

EPA, LA and oleic acid comprise approximately 70-75% of the TFAs. The improved optimized recombinant *Y. lipolytica* strains described herein are also distinguished as having less than about 0.5% GLA or DHA (when measured by GC analysis using equipment having a detectable level down to about 0.1%) and having a saturated fatty acid content of less than about 8%. This low percent of saturated fatty acids (i.e., 16:0 and 18:0) results in substantial health benefits to humans and animals.

EXAMPLES

The present invention is further defined in the following Examples. It should be understood that these Examples, while indicating preferred embodiments of the invention, are given by way of illustration only. From the above discussion and these Examples, one skilled in the art can ascertain the essential characteristics of this invention, and without departing from the spirit and scope thereof, can make various changes and modifications of the invention to adapt it to various usages and conditions.

General Methods

Standard recombinant DNA and molecular cloning techniques used in the Examples are well known in the art and are described by: 1) Sambrook, J., Fritsch, E. F. and Maniatis, T. *Molecular Cloning: A Laboratory Manual*; Cold Spring Harbor Laboratory: Cold Spring Harbor, N.Y. (1989) (Maniatis); 2) T. J. Silhavy, M. L. Bennan, and L. W. Enquist, Experiments with Gene Fusions; Cold Spring Harbor Laboratory: Cold Spring Harbor, N.Y. (1984); and, 3) Ausubel, F. M. et al., Current Protocols in Molecular Biology, published by Greene Publishing Assoc. and Wiley-Interscience, Hoboken, N.J. (1987).

Materials and methods suitable for the maintenance and growth of microbial cultures are well known in the art. Techniques suitable for use in the following examples may be found as set out in Manual of Methods for General Bacteriology (P. Gerhardt, R. G. E. Murray, R. N. Costilow, E. W. Nester, W. A. Wood, N. R. Krieg and G. B. Phillips, Eds), American Society for Microbiology: Washington, D.C. (1994)); or by Thomas D. Brock in Biotechnology: A Textbook of Industrial Microbiology, $2^{nd}$ ed., Sinauer Associates: Sunderland, Mass. (1989). All reagents, restriction enzymes and materials used for the growth and maintenance of microbial cells were obtained from DIFCO Laboratories (Detroit, Mich.), New England Biolabs, Inc. (Beverly, Mass.), GIBCO/BRL (Gaithersburg, Md.), or Sigma-Aldrich Chemical Company (St. Louis, Mo.), unless otherwise specified. *E. coli* strains were typically grown at 37° C. on Luria Bertani ["LB"] plates.

General molecular cloning was performed according to standard methods (Sambrook et al., supra). When PCR or site-directed mutagenesis was involved in subcloning, the constructs were sequenced to confirm that no errors had been introduced to the sequence. PCR products were cloned into Promega's pGEM-T-easy (Madison, Wis.) or pCR 4 TOPO (Invitrogen, San Diego, Calif.) vectors.

The meaning of abbreviations is as follows: "sec" means second(s), "min" means minute(s), "h" means hour(s), "d" means day(s), "μL" means microliter(s), "mL" means milliliter(s), "L" means liter(s), "μM" means micromolar, "mM" means millimolar, "M" means molar, "mmol" means millimole(s), "μmole" mean micromole(s), "g" means gram(s), "μg" means microgram(s), "ng" means nanogram(s), "U" means unit(s), "bp" means base pair(s), "kB" means kilobase(s), "DCW" means dry cell weight, "TFAs" means total fatty acids and "FAMEs" means fatty acid methyl esters.

Nomenclature for Expression Cassettes

The structure of an expression cassette will be represented by a simple notation system of "X::Y::Z", wherein X describes the promoter fragment, Y describes the gene fragment, and Z describes the terminator fragment, which are all operably linked to one another.

Transformation and Cultivation of *Yarrowia lipolytica*

*Yarrowia lipolytica* strain ATCC #20362 was purchased from the American Type Culture Collection (Rockville, Md.). *Y. lipolytica* strains were routinely grown at 28-30° C. in several media, according to the recipes shown below. Agar plates were prepared as required by addition of 20 g/L agar to each liquid media, according to standard methodology.

YPD agar medium (per liter): 10 g of yeast extract [Difco], 20 g of Bacto peptone [Difco], and 20 g of glucose.

Basic Minimal Media ["MM"] (per liter): 20 g glucose, 1.7 g yeast nitrogen base without amino acids, 1.0 g proline, and pH 6.1 (do not need to adjust).

Minimal Media+5-Fluoroorotic Acid ["MM+5-FOA"] (per liter): 20 g glucose, 6.7 g Yeast Nitrogen base, 75 mg uracil, 75 mg uridine and appropriate amount of FOA (Zymo Research Corp., Orange, Calif.), based on FOA activity testing against a range of concentrations from 100 mg/L to 1000 mg/L (since variation occurs within each batch received from the supplier).

High Glucose Media ["HGM"] (per liter): 80 glucose, 2.58 g $KH_2PO_4$ and 5.36 g $K_2HPO_4$, pH 7.5 (do not need to adjust).

Fermentation medium ["FM"] (per liter): 6.70 g/L Yeast nitrogen base, 6.00 g $KH_2PO_4$, 2.00 g $K_2HPO_4$, 1.50 g $MgSO_4*7H_2O$, 20 g glucose and 5.00 g Yeast extract (BBL).

Transformation of *Y. lipolytica* was performed as described in U.S. Pat. Appl. Pub. No. 2009-0093543-A1, hereby incorporated herein by reference.

Fatty Acid Analysis of *Yarrowia lipolytica*

For fatty acid ["FA"] analysis, cells were collected by centrifugation and lipids were extracted as described in Bligh, E. G. & Dyer, W. J. (*Can. J. Biochem. Physiol.*, 37:911-917 (1959)). Fatty acid methyl esters ["FAMEs"] were prepared by transesterification of the lipid extract with sodium methoxide (Roughan, G., and Nishida I., *Arch Biochem Biophys.*, 276(1):38-46 (1990)) and subsequently analyzed with a Hewlett-Packard 6890 GC fitted with a 30-m×0.25 mm (i.d.) HP-INNOWAX (Hewlett-Packard) column. The oven temperature was from 170° C. (25 min hold) to 185° C. at 3.5° C./min.

For direct base transesterification, *Yarrowia* cells (0.5 mL culture) were harvested, washed once in distilled water, and dried under vacuum in a Speed-Vac for 5-10 min. Sodium methoxide (100 μl of 1%) and a known amount of C15:0 triacylglycerol (C15:0 TAG; Cat. No. T-145, Nu-Check Prep, Elysian, Minn.) was added to the sample, and then the sample was vortexed and rocked for 30 min at 50° C. After adding 3 drops of 1 M NaCl and 400 μl hexane, the sample was vortexed and spun. The upper layer was removed and analyzed by GC.

Alternately, a modification of the base-catalysed transesterification method described in *Lipid Analysis*, William W. Christie, 2003 was used for routine analysis of the broth samples from either fermentation or flask samples. Specifically, broth samples were rapidly thawed in room temperature water, then weighed (to 0.1 mg) into a tarred 2 mL microcentrifuge tube with a 0.22 μm Corning® Costar® Spin-X® centrifuge tube filter (Cat. No. 8161). Sample (75-800 μl) was used, depending on the previously determined DCW. Using an Eppendorf 5430 centrifuge, samples are centrifuged for 5-7 min at 14,000 rpm or as long as necessary to remove the broth. The filter was removed, liquid was drained, and ~500 μl of deionized water was added to the filter to wash the sample. After centrifugation to remove the water, the filter was again removed, the liquid drained and the filter re-inserted. The tube was then re-inserted into the centrifuge, this time with the top open, for ~3-5 min to dry. The filter was then cut approximately ½ way up the tube and inserted into a fresh 2 mL round bottom Eppendorf tube (Cat. No. 22 36 335-2).

The filter was pressed to the bottom of the tube with an appropriate tool that only touches the rim of the cut filter container and not the sample or filter material. A known amount of C15:0 TAG (supra) in toluene was added and 500 μl of freshly made 1% sodium methoxide in methanol solution. The sample pellet was firmly broken up with the appropriate tool and the tubes were closed and placed in a 50° C. heat block (VWR Cat. No. 12621-088) for 30 min. The tubes were then allowed to cool for at least 5 min. Then, 400 μl of hexane and 500 μl of a 1 M NaCl in water solution were added, the tubes were vortexed for 2×6 sec and centrifuged for 1 min. Approximately 150 μl of the top (organic) layer was placed into a GC vial with an insert and analyzed by GC.

FAME peaks recorded via GC analysis were identified by their retention times, when compared to that of known fatty acids, and quantitated by comparing the FAME peak areas with that of the internal standard (C15:0 TAG) of known amount. Thus, the approximate amount (μg) of any fatty acid FAME ["μg FAME"] is calculated according to the formula: (area of the FAME peak for the specified fatty acid/area of the standard FAME peak)*(μg of the standard C15:0 TAG), while the amount (μg) of any fatty acid ["μg FA"] is calculated according to the formula: (area of the FAME peak for the specified fatty acid/area of the standard FAME peak)*(μg of the standard C15:0 TAG)*0.9503, since 1 μg of C15:0 TAG is equal to 0.9503 μg fatty acids. Note that the 0.9503 conversion factor is an approximation of the value determined for most fatty acids, which range between 0.95 and 0.96.

The lipid profile, summarizing the amount of each individual fatty acid as a wt % of TFAs, was determined by dividing the individual FAME peak area by the sum of all FAME peak areas and multiplying by 100.

Analysis of Total Lipid Content and Composition in *Yarrowia lipolytica* by Flask Assay For a detailed analysis of the total lipid content and composition in a particular strain of *Y. lipolytica*, flask assays were conducted as followed. Specifically, one loop of freshly streaked cells was inoculated into 3 mL FM medium and grown overnight at 250 rpm and 30° C. The $OD_{600nm}$ was measured and an aliquot of the cells were added to a final $OD_{600nm}$ of 0.3 in 25 mL FM medium in a 125 mL flask. After 2 days in a shaking incubator at 250 rpm and at 30° C., 6 mL of the culture was harvested by centrifugation and resuspended in 25 mL HGM in a 125 mL flask. After 5 days in a shaking incubator at 250 rpm and at 30° C., a 1 mL aliquot was used for fatty acid analysis (supra) and 10 mL dried for dry cell weight ["DCW"] determination.

For DCW determination, 10 mL culture was harvested by centrifugation for 5 min at 4000 rpm in a Beckman GH-3.8 rotor in a Beckman GS-6R centrifuge. The pellet was resuspended in 25 mL of water and re-harvested as above. The washed pellet was re-suspended in 20 mL of water and transferred to a pre-weighed aluminum pan. The cell suspension was dried overnight in a vacuum oven at 80° C. The weight of the cells was determined.

Total lipid content of cells ["TFAs % DCW"] is calculated and considered in conjunction with data tabulating the concentration of each fatty acid as a weight percent of TFAs ["% TFAs"] and the EPA content as a percent of the dry cell weight ["EPA % DCW"].

Example 1

Generation of *Yarrowia lipolytica* Strain Z1978, Producing at Least about 58.7 EPA % TFAs with at Least about 38.3 TFAs % DCW The present Example describes the construction of strain Z1978, derived from *Yarrowia lipolytica* ATCC #20362, capable of producing about 58.7 EPA % TFAs with 38.3 TFAs % DCW via expression of a delta-9 elongase/delta-8 desaturase pathway.

Genotype of *Yarrowia lipolytica* Strain Y9502

Figure 3A:
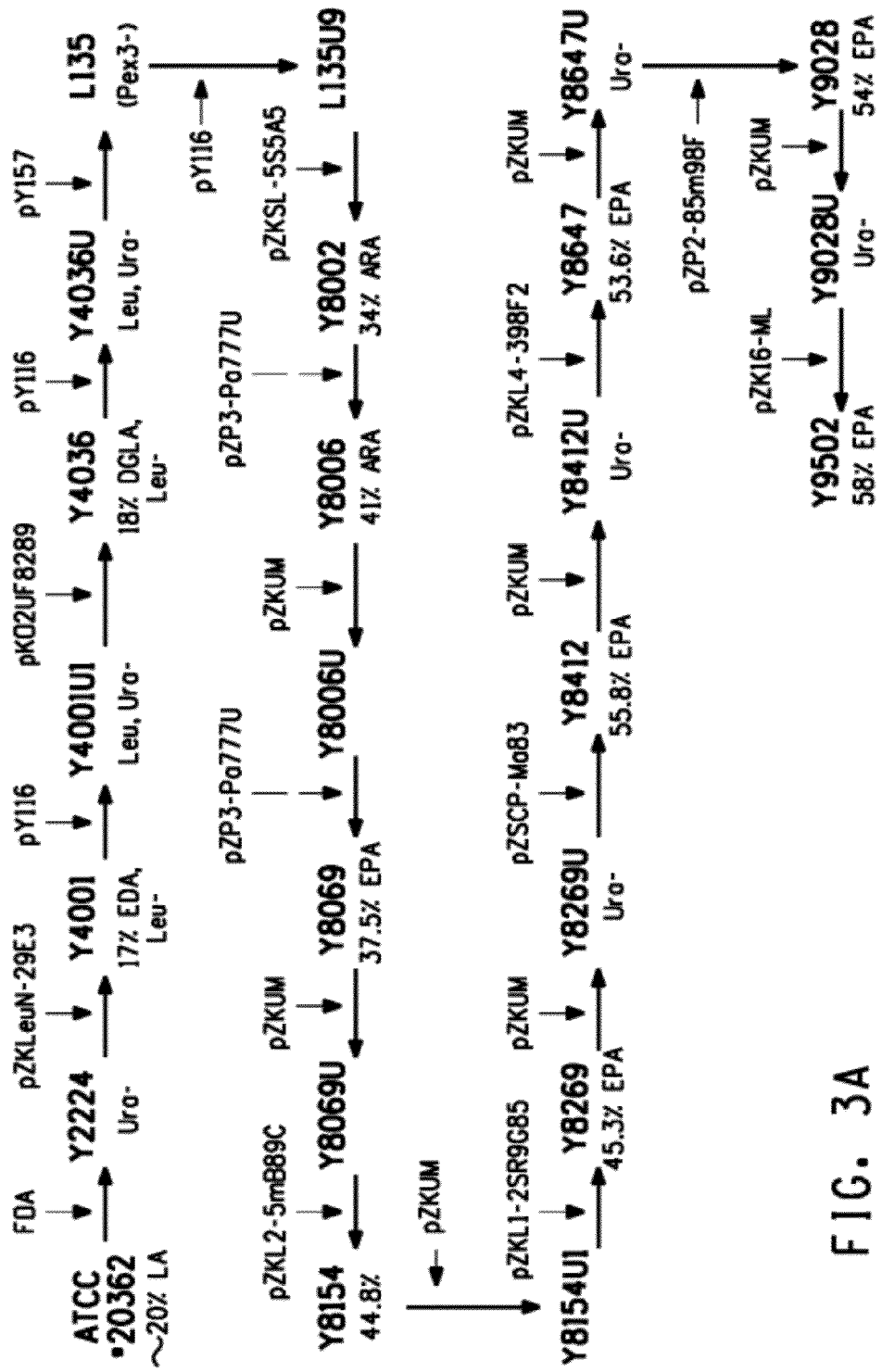

The generation of strain Y9502 is described in U.S. Pat. Appl. Pub. No. 2010-0317072-A1. Strain Y9502, derived from *Y. lipolytica* ATCC #20362, was capable of producing about 57.0% EPA relative to the total lipids via expression of a delta-9 elongase/delta-8 desaturase pathway (FIG. 3A).

The final genotype of strain Y9502 with respect to wildtype *Yarrowia lipolytica* ATCC #20362 was Ura+, Pex3−, unknown 1−, unknown 2−, unknown 3−, unknown 4−, unknown 5−, unknown 6−, unknown 7−, unknown 8−, unknown 9−, unknown 10−, YAT1::ME3S::Pex16, GPD::ME3S::Pex20, YAT1::ME3S::Lip1, FBAINm::EgD9eS::Lip2, EXP1::EgD9eS::Lip1, GPAT::EgD9e::Lip2, YAT1::EgD9eS::Lip2, FBAINm::EgD8M::Pex20, EXP1::EgD8M::Pex16, FBAIN::EgD8M::Lip1, GPD::EaD8S::Pex16 (2 copies), YAT1::E389D9eS/EgD8M::Lip1, YAT1::EgD9eS/EgD8M::Aco, FBAINm::EaD9eS/EaD8S::Lip2, GPD::FmD12::Pex20, YAT1::FmD12::Oct, EXP1::FmD12S::Aco, GPDIN::FmD12::Pex16, EXP1::EgD5M::Pex16, FBAIN::EgD5SM::Pex20, GPDIN::EgD5SM::Aco, GPM::EgD5SM::Oct, EXP1::EgD5SM::Lip1, YAT1::EaD5SM::Oct, FBAINm::PaD17::Aco, EXP1::PaD17::Pex16, YAT1::PaD17S::Lip1, YAT1::YICPT1::Aco, YAT1::MCS::Lip1, FBA::MCS::Lip1, YAT1::MaLPAAT1S::Pex16. Abbreviations are as follows: FmD12 is a *Fusarium moniliforme* delta-12 desaturase gene [U.S. Pat. No. 7,504,259]; FmD12S is a codon-optimized delta-12 desaturase gene, derived from *Fusarium moniliforme* [U.S. Pat. No. 7,504,259]; ME3S is a codon-optimized $C_{16/18}$ elongase gene, derived from *Mortierella alpina* [U.S. Pat. No. 7,470,532]; EgD9e is a *Euglena gracilis* delta-9 elongase gene [U.S. Pat. No. 7,645,604]; EgD9eS is a codon-optimized delta-9 elongase gene, derived from *Euglena gracilis* [U.S. Pat. No. 7,645,604]; EgD8M is a synthetic mutant delta-8 desaturase gene [U.S. Pat. No. 7,709,239], derived from *Euglena gracilis* [U.S. Pat. No. 7,256,033]; EaD8S is a codon-optimized delta-8 desaturase gene, derived from *Euglena anabaena* [U.S. Pat. No. 7,790,156]; E389D9eS/EgD8M is a DGLA synthase created by linking a codon-optimized delta-9 elongase gene ("E389D9eS"), derived from *Eutreptiella* sp. CCMP389 (U.S. Pat. No. 7,645,604), to the delta-8 desaturase "EgD8M" (supra) [U.S. Pat. Appl. Pub. No. 2008-0254191-A1];

EgD9eS/EgD8M is a DGLA synthase created by linking the delta-9 elongase "EgD9eS" (supra) to the delta-8 desaturase "EgD8M" (supra) [U.S. Pat. Appl. Pub. No. 2008-0254191-A1]; EaD9eS/EgD8M is a DGLA synthase created by linking a codon-optimized delta-9 elongase gene ("EaD9eS"), derived from Euglena anabaena [U.S. Pat. No. 7,794,701], to the delta-8 desaturase "EgD8M" (supra) [U.S. Pat. Appl. Pub. No. 2008-0254191-A1]; EgD5M and EgD5SM are synthetic mutant delta-5 desaturase genes comprising a mutant HPGs (SEQ ID NO:427) motif [U.S. Pat. App. Pub. 2010-0075386-A1], derived from *Euglena gracilis* [U.S. Pat. No. 7,678,560]; EaD5SM is a synthetic mutant delta-5 desaturase gene comprising a mutant HaGG (SEQ ID NO:428) motif [U.S. Pat. App. Pub. 2010-0075386-A1], derived from Euglena anabaena [U.S. Pat. No. 7,943,365]; PaD17 is a *Pythium aphanidermatum* delta-17 desaturase gene [U.S. Pat. No. 7,556,949]; PaD17S is a codon-optimized delta-17 desaturase gene, derived from *Pythium aphanidermatum* [U.S. Pat. No. 7,556,949]; YICPT1 is a *Yarrowia lipolytica* diacylglycerol cholinephosphotransferase gene [U.S. Pat. No. 7,932,077]; MCS is a codon-optimized malonyl-CoA synthetase gene, derived from *Rhizobium leguminosarum* bv. *viciae* 3841 [U.S. Pat. App. Pub. 2010-0159558-A1], and, MaLPAAT1S is a codon-optimized lysophosphatidic acid acyltransferase gene, derived from *Mortierella alpina* [U.S. Pat. No. 7,879,591].

For a detailed analysis of the total lipid content and composition in strain Y9502, a flask assay was conducted wherein cells were grown in 2 stages for a total of 7 days. Based on analyses, strain Y9502 produced 3.8 g/L DCW, 37.1 TFAs % DCW, 21.3 EPA % DCW, and the lipid profile was as follows, wherein the concentration of each fatty acid is as a weight percent of TFAs ["% TFAs"]: 16:0 (palmitate)—2.5, 16:1 (palmitoleic acid)—0.5, 18:0 (stearic acid)—2.9, 18:1 (oleic acid)—5.0, 18:2 (LA)—12.7, ALA—0.9, EDA—3.5, DGLA—3.3, ARA—0.8, ETrA—0.7, ETA—2.4, EPA—57.0, other—7.5.

Generation of *Yarrowia lipolytica* Strain Z1978 from Strain Y9502

Figure 3B:
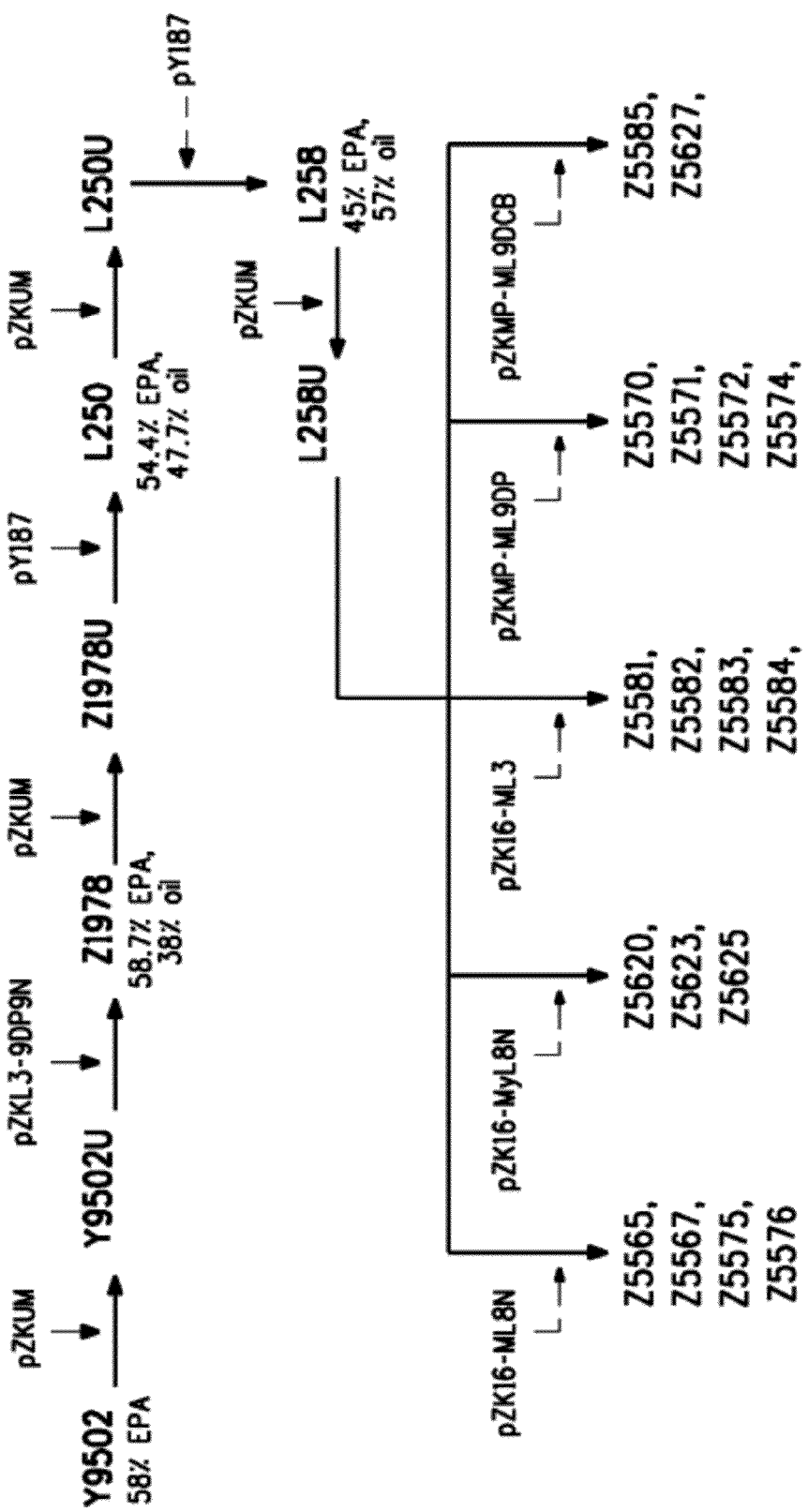

The development of strain Z1978 from strain Y9502 is shown in FIG. 3B and described in U.S. Provisional Applications No. 61/377,248 and No. 61/428,277, hereby incorporated herein by reference.

Specifically, to disrupt the Ura3 gene in strain Y9502, SalI/PacI-digested construct pZKUM (FIG. 4A; SEQ ID NO:82; described in Table 15 of U.S. Pat. Appl. Pub. No. 2009-0093543-A1, hereby incorporated herein by reference) was used to integrate an Ura3 mutant gene into the Ura3 gene of strain Y9502, according to the General Methods. A total of 27 transformants (selected from a first group comprising 8 transformants, a second group comprising 8 transformants, and a third group comprising 11 transformants) were grown on Minimal Media+5-fluoroorotic acid ["MM+5-FOA"] selection plates and maintained at 30° C. for 2 to 5 days. Further experiments determined that only the third group of transformants possessed a real Ura– phenotype.

The Ura– cells were scraped from the MM+5-FOA plates and subjected to fatty acid analysis, according to the General Methods. In this way, GC analyses showed that there were 28.5%, 28.5%, 27.4%, 28.6%, 29.2%, 30.3% and 29.6% EPA of TFAs in pZKUM-transformants #1, #3, #6, #7, #8, #10 and #11 grown on MM+5-FOA plates of group 3, respectively. These seven strains were designated as strains Y9502U12, Y9502U14, Y9502U17, Y9502U18, Y9502U19, Y9502U21 and Y9502U22, respectively (collectively, Y9502U).

Construct pZKL3-9DP9N (FIG. 4B; SEQ ID NO:83) was then generated to integrate one delta-9 desaturase gene, one choline-phosphate cytidylyl-transferase gene, and one delta-9 elongase mutant gene into the *Yarrowia* YALI0F32131p locus (GenBank Accession No. XM_506121) of strain Y9502U. The delta-9 desaturase mutant gene contained a L35G mutation with respect to EgD9eS [SEQ ID NO:3] (as described in U.S. Provisional Application No. 61/377,248 [filed Aug. 26, 2010], hereby incorporated herein by reference; see also Examples 10A-10F). Thus, the pZKL3-9DP9N plasmid contained the following components:

TABLE 8

Description of Plasmid pZKL3-9DP9N (SEQ ID NO: 83)

| RE Sites And Nucleotides Within SEQ ID NO: 83 | Description Of Fragment And Chimeric Gene Components |
|---|---|
| AscI/BsiWI (887-4) | 884 bp 5' portion of YALI0F32131p locus (GenBank Accession No. XM_506121, labeled as "Lip3-5" in Figure) |
| PacI/SphI (4396-3596) | 801 bp 3' portion of YALI0F32131p locus (GenBank Accession No. XM_506121, labeled as "Lip3-3" in Figure) |
| SwaI/BsiWI (11716-1) | YAT1::EgD9eS-L35G::Pex20, comprising: YAT1: *Yarrowia lipolytica* YAT1 promoter (labeled as "YAT" in Figure; U.S. Pat. Appl. Pub. No. 2010-0068789-A1); EgD9eS-L35G: Synthetic mutant of delta-9 elongase gene (SEQ ID NO: 43; U.S Provisional Application No. 61/377,248), derived from *Euglena gracilis* ("EgD9eS"; U.S. Pat. No. 7,645,604) (labeled as "EgD9ES-24" in Figure); Pex20: Pex20 terminator sequence from *Yarrowia* Pex20 gene (GenBank Accession No. AF054613) |
| PmeI/SwaI (8759-11716) | GPDIN::YID9::Lip1, comprising: GPDIN: *Y. lipolytica* GPDIN promoter (U.S. Pat. No. 7,459,546; labeled as "GPDPro+Intron" in Figure); YID9: *Y. lipolytica* delta-9 desaturase gene (GenBank Accession No. XM_501496; SEQ ID NO: 80) (labeled as "YID9D" in Figure); Lip1: Lip1 terminator sequence from *Yarrowia* Lip1 gene (GenBank Accession No. Z50020) |

TABLE 8-continued

Description of Plasmid pZKL3-9DP9N (SEQ ID NO: 83)

| RE Sites And Nucleotides Within SEQ ID NO: 83 | Description Of Fragment And Chimeric Gene Components |
|---|---|
| ClaII/PmeI (6501-8759) | EXP1::YIPCT::Pex16, comprising:<br>EXP1: *Y. lipolytica* export protein (EXP1) promoter (labeled as "EXP" in Figure; Intl. App. Pub. No. WO 2006/052870);<br>YIPCT: *Y. lipolytica* choline-phosphate cytidylyl-transferase ["PCT"] gene (GenBank Accession No. XM_502978; SEQ ID NO: 45);<br>Pex16: Pex16 terminator sequence from *Yarrowia* Pex16 gene (GenBank Accession No. U75433) |
| SalI/EcoRI (6501-4432) | *Yarrowia* Ura3 gene (GenBank Accession No. AJ306421) |

The pZKL3-9DP9N plasmid was digested with AscI/SphI, and then used for transformation of strain Y9502U17. The transformed cells were plated onto Minimal Media ["MM"] plates and maintained at 30° C. for 3 to 4 days. Single colonies were re-streaked onto MM plates, and then inoculated into liquid MM at 30° C. and shaken at 250 rpm/min for 2 days. The cells were collected by centrifugation, resuspended in High Glucose Media ["HGM"] and then shaken at 250 rpm/min for 5 days. The cells were subjected to fatty acid analysis, supra.

GC analyses showed that most of the selected 96 strains of Y9502U17 with pZKL3-9DP9N produced 50-56% EPA of TFAs. Five strains (i.e., #31, #32, #35, #70 and #80) that produced about 59.0%, 56.6%, 58.9%, 56.5%, and 57.6% EPA of TFAs were designated as strains Z1977, Z1978, Z1979, Z1980 and Z1981, respectively.

The final genotype of these pZKL3-9DP9N transformed strains with respect to wildtype *Yarrowia lipolytica* ATCC #20362 was Ura+, Pex3−, unknown 1−, unknown 2−, unknown 3−, unknown 4−, unknown 5−, unknown 6−, unknown 7−, unknown 8−, unknown 9−, unknown 10−, unknown 11−, YAT1::ME3S::Pex16, GPD::ME3S::Pex20, YAT1::ME3S::Lip1, FBAINm::EgD9eS::Lip2, EXP1::EgD9eS::Lip1, GPAT::EgD9e::Lip2, YAT1::EgD9eS::Lip2, YAT1::EgD9eS-L35G::Pex20, FBAINm::EgD8M::Pex20, EXP1::EgD8M::Pex16, FBAIN::EgD8M::Lip1, GPD::EaD8S::Pex16 (2 copies), YAT1::E389D9eS/EgD8M::Lip1, YAT1::EgD9eS/EgD8M::Aco, FBAINm::EaD9eS/EaD8S::Lip2, GPDIN::YID9::Lip1, GPD::FmD12::Pex20, YAT1::FmD12::Oct, EXP1::FmD12S::Aco, GPDIN::FmD12::Pex16, EXP1::EgD5M::Pex16, FBAIN::EgD5SM::Pex20, GPDIN::EgD5SM::Aco, GPM::EgD5SM::Oct, EXP1::EgD5SM::Lip1, YAT1::EaD5SM::Oct, FBAINm::PaD17::Aco, EXP1::PaD17::Pex16, YAT1::PaD17S::Lip1, YAT1::YICPT1::Aco, YAT1::MCS::Lip1, FBA::MCS::Lip1, YAT1::MaLPAAT1S::Pex16, EXP1::YIPCT::Pex16.

Knockout of the YALI0F32131p locus (GenBank Accession No. XM_50612) in strains Z1977, Z1978, Z1979, Z1980 and Z1981 was not confirmed in any of these EPA strains produced by transformation with pZKL3-9DP9N.

Cells from YPD plates of strains Z1977, Z1978, Z1979, Z1980 and Z1981 were grown and analyzed for total lipid content and composition. Specifically, flask assays were conducted as described in the General Methods.

Thus, Table 7 within the Description Of Preferred Embodiments (supra) summarizes the total DCW, the TFAs % DCW, the concentration of each fatty acid ["% TFAs"] and the EPA % DCW of strains Z1977, Z1978, Z1979, Z1980 and Z1981, as determined by flask assays.

Subsequent to the filing of U.S. Provisional Application No. 61/377,248 (filed Aug. 26, 2010), strain Z1978 was subjected to partial genome sequencing. This work, as described in U.S. Provisional Application No. 61/428,277 (filed Dec. 30, 2010), determined that instead of six delta-5 desaturase genes integrated into the *Yarrowia* genome, the engineered strain actually possessed only four.

More specifically, two separate plasmid fragments (or portions thereof) were not detected in strain Z1978, as described further below.

(1) Construct pZKL2-5 mB89C (see U.S. Pat. Appl. Pub. No. 2010-0317072-A1, SEQ ID NO:131 therein) was intended to integrate one delta-5 desaturase gene into the Lip2 loci of strain Y8069U to thereby enable higher level production of EPA. However, sequencing of the genome failed to detect the Lip2.3N end portion of the pZKL2-5 mB89C fragment and the GPDIN::EgD5SM::Aco chimeric gene. DNA re-arrangement could have resulted in loss of the GPDIN::EgD5SM::Aco cassette during the generation of the Y8154 strain (FIG. 3A).

(2) Construct pZKL1-2SR9G85 (see U.S. Pat. Appl. Pub. No. 2010-0317072-A1, SEQ ID NO:132 therein) was intended to integrate one delta-5 desaturase gene into the Lip1 loci of strain Y8154U1. However, neither genome sequencing nor PCR amplification was able to detect the delta-5 desaturase gene in strain Z1978. DNA re-arrangement could have resulted in loss of the GPM::EgD5SM::Oct cassette during the generation of strain Y8269 (FIG. 3A).

Additionally, it was determined that construct pZSCP-Ma83 (see U.S. Pat. Appl. Pub. No. 2010-0317072-A1, SEQ ID NO:133 therein) and construct pZP2-85 m98F (see U.S. Pat. Appl. Pub. No. 2010-0317072-A1 SEQ ID NO:135 therein) both integrated into the YALI0B21890g locus.

Thus, the true genotype of strain Z1978 with respect to wildtype *Yarrowia lipolytica* ATCC #20362 was as follows: Ura+, Pex3−, unknown 1−, unknown 2−, unknown 3−, unknown 4−, YALI0E12947g−, unknown 6−, YALI0B21890g−, unknown 8−, unknown 10−, unknown 11−, YAT1::ME3S::Pex16, GPD::ME3S::Pex20, YAT1::ME3S::Lip1, FBAINm::EgD9eS::Lip2, EXP1::EgD9eS::Lip1, GPAT::EgD9e::Lip2, YAT1::EgD9eS::Lip2, YAT1::EgD9eS-L35G::Pex20, FBAINm::EgD8M::Pex20, EXP1::EgD8M::Pex16, FBAIN::EgD8M::Lip1, GPD::EaD8S::Pex16 (2 copies), YAT1::E389D9eS/EgD8M::Lip1, YAT1::EgD9eS/EgD8M::Aco, FBAINm::EaD9eS/EaD8S::Lip2, GPDIN::YID9::Lip1, GPD::FmD12::Pex20, YAT1::FmD12::Oct, EXP1::FmD12S::Aco, GPDIN::FmD12::Pex16, EXP1::EgD5M::Pex16, FBAIN::EgD5SM::Pex20, EXP1::EgD5SM::Lip1, YAT1::EaD5SM::Oct, FBAINm::PaD17::Aco, EXP1::PaD17::Pex16, YAT1::PaD17S::Lip1, YAT1::YICPT1::Aco, YAT1::MCS::Lip1, FBA::MCS::Lip1, YAT1::MaLPAAT1S::Pex16, EXP1::YIPCT::Pex16.

Comparison of *Yarrowia lipolytica* Strain Y9502 and Strain Z1978

The heterologous genes expressed in strain Z1978 differ from those expressed in strain Y9502 only by the additional expression of one delta-9 desaturase gene, one choline-phosphate cytidylyl-transferase gene, and one delta-9 elongase mutant (i.e., EgD9eS-L35G, as set forth in SEQ ID NOs:43 and 44). The total delta-9 elongase conversion efficiency ["% Conv"] of LA and ALA to EPA was calculated in Table 9 for Y9502 and Z1978 strains according to the following formula: ([product]/[substrate+product])*100, wherein the product was the sum of EDA % TFAs, ETrA % TFAs, DGLA % TFAs, ETA % TFAs, ARA % TFAs and EPA % TFAs and the substrate was the sum of LA % TFAs, ALA % TFAs, EDA % TFAs, ETrA % TFAs, DGLA % TFAs, ETA % TFAs, ARA % TFAs and EPA % TFAs.

TABLE 9

Comparison Of Total Lipid Content And Composition And Delta-9 Elongase Activity In Transformant *Y. lipolytica* Strains Y9502 And Z1978

|  |  | *Yarrowia lipolytica* strain Y9502 | *Yarrowia lipolytica* strain Z1978 |
|---|---|---|---|
| DCW (g/L) |  | 3.8 | 3.9 |
| TFAs % DCW |  | 37.1 | 38.3 |
| % TFAs | 16:0 | 2.5 | 2.4 |
|  | 16:1 | 0.5 | 0.4 |
|  | 18:0 | 2.9 | 2.4 |
|  | 18:1 | 5 | 4.8 |
|  | 18:2 | 12.7 | 11.1 |
|  | ALA | 0.9 | 0.7 |
|  | EDA | 3.5 | 3.2 |
|  | DGLA | 3.3 | 3.3 |
|  | ARA | 0.8 | 0.8 |
|  | ETrA | 0.7 | 0.6 |
|  | ETA | 2.4 | 2.1 |
|  | EPA | 57 | 58.7 |
|  | Other | 7.5 | 9.5 |
| EPA % DCW |  | 21.3 | 22.5 |
| Total % Conv LA to EPA |  | 83.3 | 85.3 |

As shown above, the total delta-9 elongase conversion efficiency was determined to be 83.3% in strain Y9502, while the efficiency was improved in strain Z1978 (i.e., 85.3%).

Example 2

Generation of *Yarrowia lipolytica* Strain L258, Producing at Least about 45.2 EPA % TFAs with at Least about 57.1 TFAs % DCW The present Example describes the construction of strain L258, derived from *Yarrowia lipolytica* strain Z1978 (Example 1), capable of producing about 45.2% EPA % TFAs with 57.1 TFAs % DCW via expression of a delta-9 elongase/delta-8 desaturase pathway.

The construction of strain L258 (FIG. 3B) required the construction of intermediate strains Z1978U, L250 and L250U.

Generation of Strain Z1978U (Ura3−)

To disrupt the Ura3 gene, construct pZKUM (FIG. 4A; SEQ ID NO:82; described in Table 15 of U.S. Pat. Appl. Pub. No. 2009-0093543-A1) was used to integrate an Ura3 mutant gene into the Ura3 gene of strain Z1978 in a manner similar to that described for pZKUM transformation of strain Y9502 (Example 1). A total of 16 transformants (selected from a first "B" group comprising 8 transformants and a second "C" group comprising 8 transformants) were grown and identified to possess a Ura− phenotype.

GC analyses showed the presence of 30.8%, 31%, 30.9% and 31.3% EPA of TFAs in the B group pZKUM-transformant strains #1, #2, #3, and #4, respectively, grown on MM+5-FOA plates. These 4 strains were designated as strains Z1978BU1, Z1978BU2, Z1978BU3 and Z1978BU4, respectively.

GC analyses showed the presence of 34.4%, 31.9%, 31.2% and 31% EPA of TFAs in the C group pZKUM-transformant strains #1, #2, #5, and #6, respectively, grown on MM+5-FOA plates. These 4 strains were designated as strains Z1978CU1, Z1978CU2, Z1978CU3 and Z1978CU4, respectively.

Strains Z1978BU1, Z1978BU2, Z1978BU3, Z1978BU4, Z1978CU1, Z1978CU2, Z1978CU3 and Z1978CU4 strains were collectively designated as strain Z1978U.

Generation of *Yarrowia lipolytica* Strain L250

Construct pY187 (FIG. 5A; SEQ ID NO:84) was generated to integrate one lysophosphatidic acid acyltransferase gene ["LPAAT"] and a phospholipid:diacylglycerol acyltransferase gene ["PDAT"] into the genome of strain Z1978U. The pY187 plasmid contained the following components:

TABLE 10

Components Of Plasmid pY187 (SEQ ID NO: 84)

| RE Sites And Nucleotides Within SEQ ID NO: 84 | Description Of Fragment And Chimeric Gene Components |
|---|---|
| Cla I/Swa I 6929-333 | YAT1::YIPDAT::Lip1, comprising: YAT1: *Y. lipolytica* YAT1 promoter (U.S. Pat. Appl. Pub. No. 2010-0068789-A1); YIPDAT: *Y. lipolytica* phospholipid:diacylglycerol acyltransferase gene (SEQ ID NO: 28; U.S. Pat. No. 7,901,928; GenBank Accession No. XM_504038); Lip1: terminator sequence from *Yarrowia* Lip1 gene (GenBank Accession No. Z50020) |
| 645-1525 | ColE1 plasmid origin of replication |
| 1595-2455 | Ampicillin-resistance gene |
| Sph I/Apa I 5337-3247 | FBAINm::YILPAAT1::Lip1 (complementary), comprising: FBAINm: *Y. lipolytica* FBAIN promoter (U.S. Pat. No. 7,202,356); YILPAAT1: *Y. lipolytica* lysophosphatidic acid acyltransferase gene (SEQ ID NO: 21; U.S. Pat. No. 7,189,559; GenBank Accession No. XP_504127); Lip1: terminator sequence from *Yarrowia* Lip1 gene (GenBank Accession No. Z50020) |
| Bsi WI/Pac I 6905-5407 | *Y. lipolytica* Ura 3 gene (GenBank Accession No. AJ306421) |

The pY187 plasmid was digested with SwaI/ApaI, the 6.7 kB large fragment was purified from an agarose gel, and then used for transformation of strain Z1978CU4 according to the General Methods. The transformed cells were plated onto MM plates and maintained at 30° C. for 5 days. Single colonies (19) were then re-streaked onto MM plates. The total lipid content and fatty acid composition of these strains were evaluated by flask assay, according to the General Methods.

Based on analyses, strain L250 produced 4.4 g/L DCW, 51.5 TFAs % DCW, and 26 EPA % DCW. The lipid profile was as follows, wherein the concentration of each fatty acid is as a weight percent of TFAs ["% TFAs"]: 16:0 (palmitate)—2.0, 16:1 (palmitoleic acid)—0.7, 18:0 (stearic acid)—2.8, 18:1 (oleic acid)—6.1, 18:2 (LA)—16.7, ALA—0.9, EDA—3.3, DGLA—4.9, ARA—0.7, ETrA—0.6, ETA—3.2, EPA—50.4 and other—7.4 (see also Table 7 within the Description Of Preferred Embodiments, supra).

Generation of Strain L250U (Ura3−)

To disrupt the Ura3 gene, construct pZKUM (FIG. 4A; SEQ ID NO:82; described in Table 15 of U.S. Pat. Appl. Pub. No. 2009-0093543-A1) was used to integrate an Ura3 mutant gene into the Ura3 gene of strain L250 in a manner similar to that described for pZKUM transformation of strain Y9502 (Example 1). A total of twelve 5-FOA resistant colonies were grown and identified to possess a Ura− phenotype. Strain #2 and strain #3 were designated as L250U2 and L250U3, respectively (collectively, strain L250U).

Generation of *Yarrowia lipolytica* Strain L258

Plasmid pY187 (Table 10; SEQ ID NO:84) was used to integrate additional copies of the YILPAAT gene (SEQ ID NO:21) and the YIPDAT gene (SEQ ID NO:28) into the *Yarrowia* genome of strain L250U. The 6.7 kB purified large fragment of plasmid pY187 was used for transformation of strain L250U2 according to the General Methods. The transformed cells were plated onto MM plates and maintained at 30° C. for 5 days. Single colonies were then re-streaked onto MM plates. The cells were subjected to total lipid content and composition evaluation by flask assay, according to the General Methods.

Based on analyses, strain L258 produced 5.0 g/L DCW, 57.1 TFAs % DCW, and 25.8 EPA % DCW. The lipid profile was as follows, wherein the concentration of each fatty acid is as a weight percent of TFAs ["% TFAs"]: 16:0 (palmitate)—2.3, 16:1 (palmitoleic acid)—0.9, 18:0 (stearic acid)—3.4, 18:1 (oleic acid)—7.8, 18:2 (LA)—18.7, ALA—0.9, EDA—4.0, DGLA—5.3, ARA—0.8, ETrA—0.6, ETA—3.2, EPA—45.2 and other—6.6 (see also Table 7 within the Description Of Preferred Embodiments, supra).

The final genotype of strain L258 with respect to wild type *Y. lipolytica* ATCC #20362 was: Ura+, Pex3−, unknown 1−, unknown 2−, unknown 3−, unknown 4−, YALI0E12947g−, unknown 6−, YALI0821890g−, unknown 8−, unknown 10−, unknown 11−, unknown 12−, unknown 13−, YAT1::ME3S::Pex16, GPD::ME3S::Pex20, YAT1::ME3S::Lip1, FBAINm::EgD9eS::Lip2, EXP1::EgD9eS::Lip1, GPAT::EgD9e::Lip2, YAT1::EgD9eS::Lip2, YAT1::EgD9eS-L35G::Pex20, FBAINm::EgD8M::Pex20, EXP1::EgD8M::Pex16, FBAIN::EgD8M::Lip1, GPD::EaD8S::Pex16 (2 copies), YAT1::E389D9eS/EgD8M::Lip1, YAT1::EgD9eS/EgD8M::Aco, FBAINm::EaD9eS/EaD8S::Lip2, GPDIN::YID9::Lip1, GPD::FmD12::Pex20, YAT1::FmD12::Oct, EXP1::FmD12S::Aco, GPDIN::FmD12::Pex16, EXP1::EgD5M::Pex16, FBAIN::EgD5SM::Pex20, EXP1::EgD5SM::Lip1, YAT1::EaD5SM::Oct, FBAINm::PaD17::Aco, EXP1::PaD17::Pex16, YAT1::PaD17S::Lip1, YAT1::YICPT1::Aco, YAT1::MCS::Lip1, FBA::MCS::Lip1, EXP1::YIPCT::Pex16, YAT1::MaLPAAT1S::Pex16, FBAINm::YILPAAT1::Lip1 (2 copies), YAT1::YIPDAT::Lip1 (2 copies).

Example 3

Generation of *Yarrowia lipolytica* Strains Z5565, Z5567, Z5575, and Z5576, Producing at Least about 47 EPA % TFAs with at Least about 53 TFAs % DCW The present Example describes the construction of strains Z5565, Z5567, Z5575 and Z5576, derived from *Yarrowia lipolytica* strain L258 (Example 2), capable of producing about 47 EPA % TFAs with more than 53 TFAs % DCW via expression of a delta-9 elongase/delta-8 desaturase pathway.

The development of strains Z5565, Z5567, Z5575 and Z5576 (FIG. 3B), required the construction of intermediate strain L258U.

Generation of Strain L258U (Ura3−)

To disrupt the Ura3 gene, construct pZKUM (FIG. 4A; SEQ ID NO:82; described in Table 15 of U.S. Pat. Appl. Pub. No. 2009-0093543-A1) was used to integrate an Ura3 mutant gene into the Ura3 gene of strain L258 in a manner similar to that described for pZKUM transformation of strain Y9502 (Example 1). A total of 20 transformants were grown and identified to possess a Ura− phenotype.

GC analyses showed the presence of 37.6% and 37.2% EPA, respectively, in the pZKUM-transformed strains #7 and #9 grown on MM+5-FOA plates. These 2 strains were designated as L258U5 and L258U6, respectively, collectively designated as strain L258U.

Generation of *Yarrowia lipolytica* Strains Z5565, Z5567, Z5575 and Z5576

Construct pZK16-ML8N (FIG. 5B; SEQ ID NO:85) is described in U.S. Pat. Appl. Pub. No. 2010-0317072-A1, Table 15 therein. It was generated to integrate one delta-8 desaturase within a chimeric YAT1::EgD8M::Pex20 gene, one malonyl-CoA synthetase within a chimeric FBA::MCS::Lip1 gene, and one lysophosphatidic acid acyltransferase within a chimeric YAT1::MaLPAAT1S::Pex16 gene into the *Yarrowia* YALI0B14795p locus (GenBank Accession No. XM_500900).

The pZK16-ML8N plasmid was digested with AscI/SphI, and then used for transformation of strain L258U5 and L258U6, individually, according to the General Methods. The transformed cells were plated onto MM plates and maintained at 30° C. for 5 to 6 days. Single colonies were re-streaked onto MM plates, and then inoculated into liquid MM at 30° C. and shaken at 250 rpm/min for 2 days. The cells were collected by centrifugation, resuspended in HGM and then shaken at 250 rpm/min for 5 days. The cells were subjected to fatty acid analysis, according to the General Methods.

GC analyses showed that 7 of the selected 48 strains of L258U5 with pZK16-ML8N produced more than 48% EPA of TFAs. Two strains (i.e., #3, and #36) that produced about 49.7% and 50.9% EPA of TFAs were designated as Z5565 and Z5567, respectively.

GC analyses showed that most of the selected 48 strains of L258U6 with pZK16-ML8N produced more than 49% EPA of TFAs. Two strains (i.e., #2 and #5) that produced about 53.7% and 50.2% EPA of TFAs were designated as Z5575 and Z5576, respectively.

The final genotype of these pZK16-ML8N transformant strains with respect to wildtype *Yarrowia lipolytica* ATCC #20362 was: Ura+, Pex3−, unknown 1−, unknown 2−, unknown 3−, unknown 4−, YALI0E12947g−, unknown 6−, YALI0B21890g−, unknown 8−, unknown 10−, unknown 11−, unknown 12−, unknown 13−, unknown 14−, YAT1::ME3S::Pex16, GPD::ME3S::Pex20, YAT1::ME3S::Lip1, FBAINm::EgD9eS::Lip2, EXP1::EgD9eS::Lip1, GPAT::EgD9e::Lip2, YAT1::EgD9eS::Lip2, YAT1::EgD9eS-L35G::Pex20, FBAINm::EgD8M::Pex20, EXP1::EgD8M::Pex16, FBAIN::EgD8M::Lip1, YAT1::EgD8M::Pex20, GPD::EaD8S::Pex16 (2 copies), YAT1::E389D9eS/EgD8M::Lip1, YAT1::EgD9eS/EgD8M::Aco, FBAINm::EaD9eS/EaD8S::Lip2, GPDIN::YID9::Lip1, GPD::FmD12::Pex20, YAT1::FmD12::Oct, EXP1::FmD12S::Aco, GPDIN::FmD12::Pex16, EXP1::EgD5M::Pex16, FBAIN::EgD5SM::Pex20, EXP1::EgD5SM::Lip1, YAT1::EaD5SM::Oct, FBAINm::PaD17::Aco, EXP1::PaD17::Pex16, YAT1::PaD17S::Lip1, YAT1::YlCPT1::Aco, YAT1::MCS::Lip1, FBA::MCS::Lip1 (2 copies), EXP1::YlPCT::Pex16, YAT1::MaLPAAT1S::Pex16 (2 copies), FBAINm::YlLPAAT1::Lip1 (2 copies), YAT1::YlPDAT::Lip1 (2 copies).

Knockout of the YALI0B14795p locus (GenBank Accession No. XM_500900) in strains Z5565, Z5567, Z5575 and Z5576 was not confirmed in any of these EPA strains, produced by transformation with pZK16-ML8N.

Analysis of Total Lipid Content and Composition by Flask Assay

Cells from YPD plates of strains Z5565, Z5567, Z5575 and Z5576, were grown and analyzed for total lipid content and composition, according to the General Methods.

Table 7 within the Description Of Preferred Embodiments (supra) summarizes the total DCW, the TFAs % DCW, the concentration of each fatty acid as a weight percent of TFAs ["% TFAs"] and the EPA % DCW of strains Z5565, Z5567, Z5575 and Z5576. Average DCW was 4.8 g/L, average TFAs % DCW was 55.4, average EPA % TFAs was 48.3, and average EPA % DCW was 26.75.

Example 4

Generation of *Yarrowia lipolytica* Strains Z5620, Z5623 and Z5625, Producing at Least about 49 EPA % TFAs with at Least about 51 TFAs % DCW The present Example describes the construction of strains Z5620, Z5623 and Z5625, derived from *Yarrowia lipolytica* strain L258U (Example 3), capable of producing about 49 EPA % TFAs with more than 51 TFAs DCW via expression of a delta-9 elongase/delta-8 desaturase pathway.

Figure 6B:
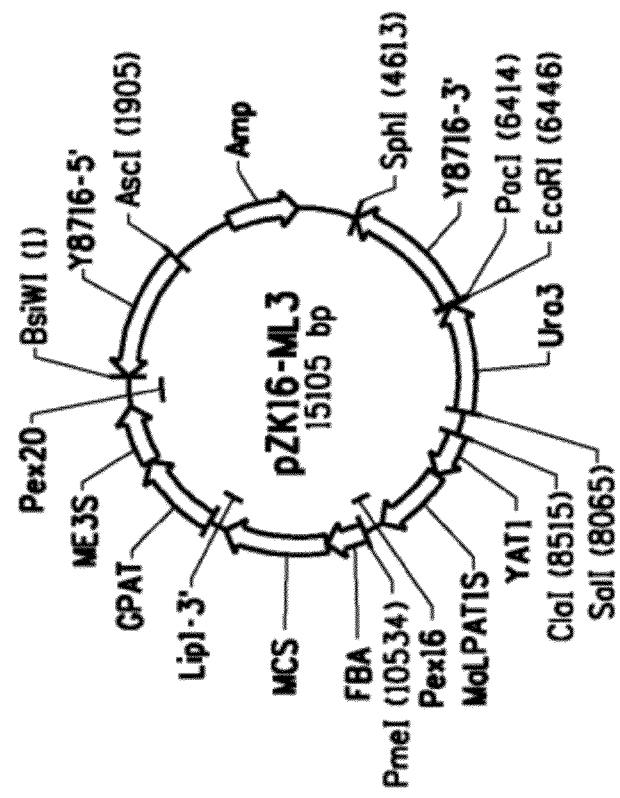
Figure 6A:
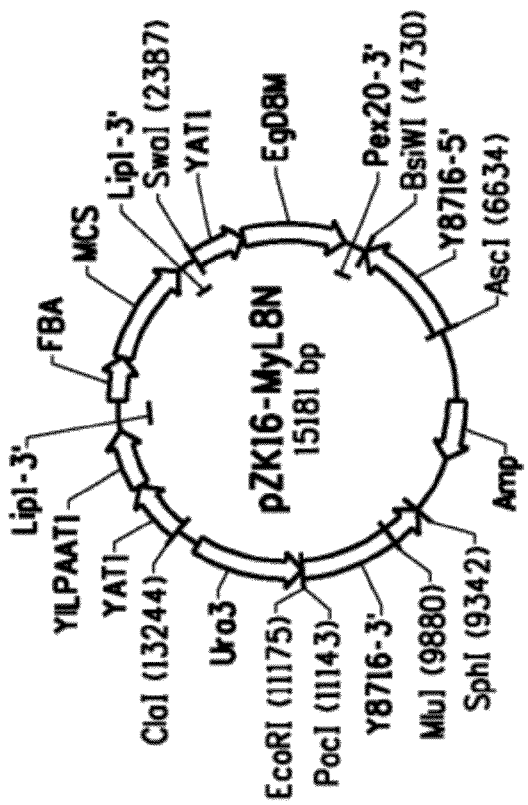

Construct pZK16-MyL8N was generated to integrate one delta-8 desaturase gene, one malonyl-CoA synthetase gene, and one lysophosphatidic acid acyltransferase gene into the *Yarrowia* YALI0B14795p locus (GenBank Accession No. XM_500900) of strain L258U. More specifically, construct pZK16-MyL8N (FIG. 6A; SEQ ID NO:86) was identical to pZK16-ML8N (FIG. 5B; SEQ ID NO:85; Example 3), with the exception that a *Yarrowia lipolytica* LPAAT gene ("YlLPAAT"; SEQ ID NO:21) and Lip1 terminator replaced the *Mortierella alpina* LPAAT gene codon-optimized for expression in *Y. lipolytica* ("MaLPAAT1S"; SEQ ID NO:19) and Pex16 terminator. The pZK16-MyL8N plasmid contained the following components:

TABLE 11

| Description of Plasmid pZK16-MyL8N (SEQ ID NO: 86) | |
|---|---|
| RE Sites And Nucleotides Within SEQ ID NO: 86 | Description Of Fragment And Chimeric Gene Components |
| AscI/BsiWI (6634-4730) | 1904 bp 5' portion of YALI0B14795p locus (GenBank Accession No. XM_500900, labeled as "Y8716-5'" in Figure) |
| PacI/SphI (11143-9342) | 1801 bp 3' portion of YALI0B14795p locus (GenBank Accession No. XM_500900, labeled as "Y8716-3'" in Figure) |
| SwaI/BsiWI (2387-4730) | YAT1::EgD8M::Pex20, comprising: YAT1: *Yarrowia lipolytica* YAT1 promoter (U.S. Pat. Appl. Pub. No. 2010-0068789-A1); EgD8M: Synthetic mutant delta-8 desaturase (SEQ ID NO: 87; U.S. Pat. No. 7,709,239), derived from *Euglena gracilis* ("EgD8S"; U.S. Pat. No. 7,256,033); Pex20: Pex20 terminator sequence from *Yarrowia* Pex20 gene (GenBank Accession No. AF054613) |

TABLE 11-continued

| Description of Plasmid pZK16-MyL8N (SEQ ID NO: 86) | |
|---|---|
| RE Sites And Nucleotides Within SEQ ID NO: 86 | Description Of Fragment And Chimeric Gene Components |
| 1-2387 | FBA::MCS::Lip1, comprising: FBA: *Y. lipolytica* FBA promoter (U.S. Pat. No. 7,202,356); MCS: codon-optimized malonyl-CoA synthetase gene (SEQ ID NO: 49), derived from *Rhizobium leguminosarum* bv. *viciae* 3841 (U.S. Pat. Appl. Pub. No. 2010-0159558-A1); Lip1: Lip1 terminator sequence from *Yarrowia* Lip1 gene (GenBank Accession No. Z50020) |
| 13244-1 | YAT1::YlLPAAT::Lip1, comprising: YAT1: *Y. lipolytica* YAT1 promoter (U.S. Pat. Appl. Pub. No. 2010-0068789-A1); YlLPAAT1: *Y. lipolytica* lysophosphatidic acid acyltransferase gene (SEQ ID NO: 21; U.S. Pat. No. 7,189,559; GenBank Accession No. XP_504127) Lip1: Lip1 terminator sequence from *Yarrowia* Lip1 gene (GenBank Accession No. Z50020) |
| SalI/EcoRI (12794-11175) | *Yarrowia* Ura3 gene (GenBank Accession No. AJ306421) |

The pZK16-MyL8N plasmid was digested with AscI/SphI, and then used for transformation of strain L258U6, according to the General Methods. The transformant cells were plated onto MM plates and maintained at 30° C. for 5 to 6 days. Single colonies were re-streaked onto MM plates, and then inoculated into liquid MM at 30° C. and shaken at 250 rpm/min for 2 days. The cells were collected by centrifugation, resuspended in HGM and then shaken at 250 rpm/min for 5 days. The cells were subjected to fatty acid analysis, as set forth in the General Methods above.

GC analyses showed that almost all of the selected 48 strains of L258U6 transformed with pZK16-MyL8N produced more than 49% EPA of TFAs. Three strains (i.e., #5, #21 and #48) that produced about 52.8%, 53.0% and 49.9% EPA of TFAs were designated as Z5620, Z5623 and Z5625, respectively.

The final genotype of these pZK16-MyL8N transformant strains with respect to wildtype *Yarrowia lipolytica* ATCC #20362 was: Ura+, Pex3−, unknown 1−, unknown 2−, unknown 3−, unknown 4−, YALI0E12947g−, unknown 6−, YALI0B21890g−, unknown 8−, unknown 10−, unknown 11−, unknown 12−, unknown 13−, unknown 14−, YAT1::ME3S::Pex16, GPD::ME3S::Pex20, YAT1::ME3S::Lip1, FBAINm::EgD9eS::Lip2, EXP1::EgD9eS::Lip1, GPAT::EgD9e::Lip2, YAT1::EgD9eS::Lip2, YAT1::EgD9eS-L35G::Pex20, FBAINm::EgD8M::Pex20, EXP1::EgD8M::Pex16, FBAIN::EgD8M::Lip1, YAT1::EgD8M::Pex20, GPD::EaD8S::Pex16 (2 copies), YAT1::E389D9eS/EgD8M::Lip1, YAT1::EgD9eS/EgD8M::Aco, FBAINm::EaD9eS/EaD8S::Lip2, GPDIN::YlD9::Lip1, GPD::FmD12::Pex20, YAT1::FmD12::Oct, EXP1::FmD12S::Aco, GPDIN::FmD12::Pex16, EXP1::EgD5M::Pex16, FBAIN::EgD5SM::Pex20, EXP1::EgD5SM::Lip1, YAT1::EaD5SM::Oct, FBAINm::PaD17::Aco, EXP1::PaD17::Pex16, YAT1::PaD17S::Lip1, YAT1::YlCPT1::Aco, YAT1::MCS::Lip1, FBA::MCS::Lip1 (2 copies), EXP1::YlPCT::Pex16, YAT1::MaLPAAT1S::Pex16, YAT1::YlLPAAT::Lip1, FBAINm::YlLPAAT1::Lip1 (2 copies), YAT1::YlPDAT::Lip1 (2 copies).

Knockout of the YALI0B14795p locus (GenBank Accession No. XM_500900) in strains Z5620, Z5623 and Z5625, was not confirmed in any of these EPA strains, produced by transformation with pZK16-MyL8N.

Analysis of Total Lipid Content and Composition by Flask Assay

Cells from YPD plates of strains Z5620, Z5623 and Z5625 were grown and analyzed for total lipid content and composition, according to the General Methods.

Table 7 within the Description Of Preferred Embodiments (supra) summarizes the total DCW, the TFAs % DCW, the concentration of each fatty acid as a weight percent of TFAs ["% TFAs"] and the EPA % DCW of strains Z5620, Z5623 and Z5625. Average DCW was 4.5 g/L, average TFAs % DCW was 52.4, average EPA % TFAs was 48.4, and average EPA % DCW was 25.9.

Example 5

Generation of Yarrowia lipolytica Strains Z5581, Z5582, Z5583 and Z5584, Producing at Least about 48 EPA % TFAs with at Least about 55 TFAs % DCW The present Example describes the construction of strains Z5581, Z5582, Z5583 and Z5584, derived from Yarrowia lipolytica strain L258U (Example 3), capable of producing about 48 EPA % TFAs with more than 55 TFAs % DCW via expression of a delta-9 elongase/delta-8 desaturase pathway.

Construct pZK16-ML3 (FIG. 6B, SEQ ID NO:89) was generated to integrate one malonyl-CoA synthetase gene, and one lysophosphatidic acid acyltransferase gene and one $C_{16/18}$ elongase gene into the Yarrowia YALI0B14795p locus (GenBank Accession No. XM_500900) of strain L258U. The pZK16-ML3 plasmid contained the following components:

TABLE 12

Description of Plasmid pZK16-ML3 (SEQ ID NO: 89)

| RE Sites And Nucleotides Within SEQ ID NO: 89 | Description Of Fragment And Chimeric Gene Components |
|---|---|
| AscI/BsiWI (1905-1) | 1904 bp 5' portion of YALI0B14795p locus (GenBank Accession No. XM_500900, labeled as "Y8716-5'" in Figure) |
| PacI/SphI (6414-4613) | 1801 bp 3' portion of YALI0B14795p locus (GenBank Accession No. XM_500900, labeled as "Y8716-3'" in Figure) |
| SwaI/BsiWI (12920-1) | GPAT::ME3S::Pex20, comprising:<br>GPAT: Yarrowia lipolytica GPAT promoter (PCT Publication No. WO 2006/031937);<br>ME3S: codon-optimized $C_{16/18}$ elongase gene (SEQ ID NO: 90), derived from Mortierella alpina (U.S. Pat. No. 7,470,532);<br>Pex20: Pex20 terminator sequence from Yarrowia Pex20 gene (GenBank Accession No. AF054613) |
| PmeI/SwaI (10534-12920) | FBA::MCS::Lip1, comprising:<br>FBA: Y. lipolytica FBA promoter (U.S. Pat. No. 7,202,356);<br>MCS: codon-optimized malonyl-CoA synthetase gene (SEQ ID NO: 49), derived from Rhizobium leguminosarum bv. viciae 3841 (U.S. Pat. Appl. Pub. No. 2010-0159558-A1);<br>Lip1: Lip1 terminator sequence from Yarrowia Lip1 gene (GenBank Accession No. Z50020) |
| ClaII/PmeI (8515-10534) | YAT1::MaLPAAT1S::Pex16, comprising:<br>YAT1: Y. lipolytica YAT1 promoter (U.S. Pat. Appl. Pub. No. 2010-0068789-A1);<br>MaLPAAT1S: codon-optimized lysophosphatidic acid acyltransferase gene (SEQ ID NO: 19), derived from M. alpina (U.S. Pat. No. 7,879,591);<br>Pex16: Pex16 terminator sequence from Yarrowia Pex16 gene (GenBank Accession No. U75433) |
| SalI/EcoRI (8065-6446) | Yarrowia Ura3 gene (GenBank Accession No. AJ306421) |

The pZK16-ML3 plasmid was digested with AscI/SphI, and then used for transformation of strain L258U5, according to the General Methods. The transformant cells were plated onto MM plates and maintained at 30° C. for 4 to 5 days. Single colonies were re-streaked onto MM plates, and then inoculated into liquid MM at 30° C. and shaken at 250 rpm/min for 2 days. The cells were collected by centrifugation, resuspended in HGM and then shaken at 250 rpm/min for 5 days. The cells were subjected to fatty acid analysis, according to the General Methods.

GC analyses showed that 19 of the selected 48 strains of L258U5 transformed with pZK16-ML3 produced more than 50% EPA of TFAs. Four strains (i.e., #16, #42, #46, and #47) that produced about 50.9%, 52.4%, 51.5% and 51.7% EPA of TFAs were designated as Z5581, Z5582, Z5583 and Z5584, respectively.

The final genotype of these pZK16-ML3 transformed strains with respect to wildtype Yarrowia lipolytica ATCC #20362 was: Ura+, Pex3−, unknown 1−, unknown 2−, unknown 3−, unknown 4−, YALI0E12947g−, unknown 6−, YALI0B21890g−, unknown 8−, unknown 10−, unknown 11−, unknown 12−, unknown 13−, unknown 14−, YAT1::ME3S::Pex16, GPD::ME3S::Pex20, YAT1::ME3S::Lip1, GPAT::ME3S::Pex20, FBAINm::EgD9eS::Lip2, EXP1::EgD9eS::Lip1, GPAT::EgD9e::Lip2, YAT1::EgD9eS::Lip2, YAT1::EgD9eS-L35G::Pex20, FBAINm::EgD8M::Pex20, EXP1::EgD8M::Pex16, FBAIN::EgD8M::Lip1, GPD::EaD8S::Pex16 (2 copies), YAT1::E389D9eS/EgD8M::Lip1, YAT1::EgD9eS/EgD8M::Aco, FBAINm::EaD9eS/EaD8S::Lip2, GPDIN::YID9::Lip1, GPD::FmD12::Pex20, YAT1::FmD12::Oct, EXP1::FmD12S::Aco, GPDIN::FmD12::Pex16, EXP1::EgD5M::Pex16, FBAIN::EgD5SM::Pex20, EXP1::EgD5SM::Lip1, YAT1::EaD5SM::Oct, FBAINm::PaD17::Aco, EXP1::PaD17::Pex16, YAT1::PaD17S::Lip1, YAT1::YICPT1::Aco, YAT1::MCS::Lip1, FBA::MCS::Lip1 (2 copies), EXP1::YIPCT::Pex16, YAT1::MaLPAAT1S::Pex16 (2 copies), FBAINm::YILPAAT1::Lip1 (2 copies), YAT1::YIPDAT::Lip1 (2 copies).

Knockout of the YALI0B14795 locus (GenBank Accession No. XM_500900) in Z5581, Z5582, Z5583 and Z5584 was not confirmed in any of these EPA strains, produced by transformation with pZK16-ML3.

Analysis of Total Lipid Content and Composition by Flask Assay

Cells from YPD plates of strains Z5581, Z5582, Z5583 and Z5584, were grown and analyzed for total lipid content and composition, according to the General Methods.

Table 7 within the Description Of Preferred Embodiments (supra) summarizes the total DCW, the TFAs % DCW, the concentration of each fatty acid as a weight percent of TFAs ["% TFAs"] and the EPA % DCW of strains Z5581, Z5582, Z5583 and Z5584. Average DCW was 4.8 g/L, average TFAs % DCW was 56, average EPA % TFAs was 48.65, and average EPA % DCW was 27.2.

Example 6

Generation of Yarrowia lipolytica Strains Z5570, Z5571, Z5572 And Z5574, Producing at Least about 48 EPA % TFAs with at Least about 54 TFAs % DCW The present Example describes the construction of strains Z5570, Z5571, Z5572 and Z5574, derived from Yarrowia lipolytica strain L258U (Example 3), capable of producing about 48 EPA % TFAs with more than 54 TFAs % DCW via expression of a delta-9 elongase/delta-8 desaturase pathway.

Construct pZKMP-ML9DP (FIG. 7A, SEQ ID NO:92) was generated to integrate one lysophosphatidic acid acyltransferase gene, one delta-9 desaturase gene and one cholinephosphate cytidylyltransferase gene, into the *Yarrowia* YALI0F02211g locus (GenBank Accession No. XP_504895) of strain L258U. The pZKMP-ML9DP plasmid contained the following components:

TABLE 13

Description of Plasmid pZKMP-ML9DP (SEQ ID NO: 92)

| RE Sites And Nucleotides Within SEQ ID NO: 92 | Description Of Fragment And Chimeric Gene Components |
|---|---|
| AscI/BsiWI (696-1) | 695 bp 5' portion of YALI0F02211g locus (GenBank Accession No. XP_504895; labeled as "yM1DP-5" in Figure) |
| PacI/SphI (4201-3404) | 797 bp 3' portion of YALI0F02211g locus (GenBank Accession No. XP_504895; labeled as "yM1DP-3" in Figure |
| SwaI/BsiWI (11068-1) | ALK2LM1::MaLPAAT1S::Pex20, comprising: ALK2LM1: *Yarrowia lipolytica* ALK2LM1 promoter plus N-terminal 66 bp coding region of *Y. lipolytica* AIK2 gene (SEQ ID NO: 93; U.S. Provisional Patent Appl. No. 61/471,746, filed Apr. 5, 2011 [Attorney Docket No, CL5381USPRV]); MaLPAAT1S: codon-optimized lysophosphatidic acid acyltransferase gene (SEQ ID NO: 19), derived from *Mortierella alpine* (U.S. Pat. No. 7,879,591); Pex20: Pex20 terminator sequence from *Yarrowia* Pex20 gene (GenBank Accession No. AF054613) |
| PmeI/SwaI (8560-11068) | DGAT2M::YID9::Lip1, comprising: DGAT2M: *Y. lipolytica* DGAT2M promoter (SEQ ID NO: 94; U.S. Provisional Patent Appl. No. 61/469,933, filed Mar. 31, 2011 [Attorney Docket No. CL4736USPRV]); YID9: *Y. lipolytica* delta-9 desaturase gene (labeled as "YID9DS" in Figure; GenBank Accession No. XM_501496.1; SEQ ID NO: 80); Lip1: Lip1 terminator sequence from *Yarrowia* Lip1 gene (GenBank Accession No. Z50020) |
| ClaII/PmeI (6302-8560) | EXP1::YIPCT::Pex16, comprising: EXP1: *Y. lipolytica* export protein (EXP1) promoter (labeled as "EXP" in Figure; Intl. App. Pub. No. WO 2006/052870); YIPCT: *Y. lipolytica* cholinephosphate cytidylyltransferase gene (GenBank Accession No. XP_502978; SEQ ID NO: 45); Pex16: Pex16 terminator sequence from *Yarrowia* Pex16 gene (GenBank Accession No. U75433) |
| SalI/EcoRI (5852-4233) | *Yarrowia* Ura3 gene (GenBank Accession No. AJ306421) |

The pZKMP-ML9DP plasmid was digested with AscI/SphI, and then used for transformation of strain L258U5, according to the General Methods. The transformant cells were plated onto MM plates and maintained at 30° C. for 5 days. Single colonies were re-streaked onto MM plates, and then inoculated into liquid MM at 30° C. and shaken at 250 rpm/min for 2 days. The cells were collected by centrifugation, resuspended in HGM and then shaken at 250 rpm/min for 5 days. The cells were subjected to fatty acid analysis, according to the General Methods.

GC analyses showed that 22 of the selected 48 strains of L258U5 transformed with pZKMP-ML9DP produced more than 50% EPA of TFAs. Four strains (i.e., #17, #25, #40 and #46) that produced about 53.5%, 51.8%, 52.9% and 51.8% EPA of TFAs were designated as Z5570, Z5571, Z5572 and Z5574, respectively.

The final genotype of these pZKMP-ML9DP transformant strains with respect to wildtype *Yarrowia lipolytica* ATCC #20362 was: Ura+, Pex3−, unknown 1−, unknown 2−, unknown 3−, unknown 4−, YALI0E12947g−, unknown 6−, YALI0B21890g−, unknown 8−, unknown 10−, unknown 11−, unknown 12−, unknown 13−, unknown 14−, YAT1::ME3S::Pex16, GPD::ME3S::Pex20, YAT1::ME3S::Lip1, FBAINm::EgD9eS::Lip2, EXP1::EgD9eS::Lip1, GPAT::EgD9e::Lip2, YAT1::EgD9eS::Lip2, YAT1::EgD9eS-L35G::Pex20, FBAINm::EgD8M::Pex20, EXP1::EgD8M::Pex16, FBAIN::EgD8M::Lip1, GPD::EaD8S::Pex16 (2 copies), YAT1::E389D9eS/EgD8M::Lip1, YAT1::EgD9eS/EgD8M::Aco, FBAINm::EaD9eS/EaD8S::Lip2, DGAT2M::YID9::Lip1, GPDIN::YID9::Lip1, GPD::FmD12::Pex20, YAT1::FmD12::Oct, EXP1::FmD12S::Aco, GPDIN::FmD12::Pex16, EXP1::EgD5M::Pex16, FBAIN::EgD5SM::Pex20, EXP1::EgD5SM::Lip1, YAT1::EaD5SM::Oct, FBAINm::PaD17::Aco, EXP1::PaD17::Pex16, YAT1::PaD17S::Lip1, YAT1::YICPT1::Aco, YAT1::MCS::Lip1, FBA::MCS::Lip1, EXP1::YIPCT::Pex16 (2 copies), YAT1::MaLPAAT1S::Pex16, ALK2LM1::MaLPAAT1S::Pex20, FBAINm::YIL-PAAT1::Lip1 (2 copies), YAT1::YIPDAT::Lip1 (2 copies).

Knockout of the YALI0F02211g locus (GenBank Accession No. XP_504895) in strains Z5570, Z5571, Z5572 and Z5574 was not confirmed in any of these EPA strains, produced by transformation with pZKMP-ML9DP.

Analysis of Total Lipid Content and Composition by Flask Assay

Cells from YPD plates of strains Z5570, Z5571, Z5572 and Z5574, were grown and analyzed for total lipid content and composition, according to the General Methods.

Table 7 within the Description Of Preferred Embodiments (supra) summarizes the total DCW, the TFAs % DCW, the concentration of each fatty acid as a weight percent of TFAs ["% TFAs"] and the EPA % DCW of strains Z5570, Z5571, Z5572 and Z5574. Average DCW was 4.9 g/L, average TFAs % DCW was 54.2, average EPA % TFAs was 48.9, and average EPA % DCW was 26.55.

Example 7

Generation of *Yarrowia lipolytica* Strains Z5585 And Z5627, Producing at Least about 49 EPA % TFAs with at Least about 52 TFAs % DCW The present Example describes the construction of strains Z5585 and Z5627, derived from *Yarrowia lipolytica* strain L258U (Example 3), capable of producing about 49 EPA % TFAs with more than 52 TFAs % DCW via expression of a delta-9 elongase/delta-8 desaturase pathway.

Construct pZKMP-ML9DCB (FIG. 7B, SEQ ID NO:95) was generated to integrate one lysophosphatidic acid acyltransferase gene, one delta-9 desaturase gene and one diacylglycerol cholinephosphotransferase gene into the *Yarrowia* YALI0F02211g locus (GenBank Accession No. XP_504895) of strain L258U. The pZKMP-ML9DCB plasmid contained the following components:

TABLE 14

Description of Plasmid pZKMP-ML9DCB (SEQ ID NO: 95)

| RE Sites And Nucleotides Within SEQ ID NO: 95 | Description Of Fragment And Chimeric Gene Components |
|---|---|
| AscI/BsiWI (7715-7020) | 695 bp 5' portion of YALI0F02211g locus (GenBank Accession No. XP_504895), labeled as "yM1DP--5" in Figure) |

TABLE 14-continued

Description of Plasmid pZKMP-ML9DCB (SEQ ID NO: 95)

| RE Sites And Nucleotides Within SEQ ID NO: 95 | Description Of Fragment And Chimeric Gene Components |
|---|---|
| PacI/SphI (11220-10423) | 797 bp 3' portion of YALI0F02211g locus (GenBank Accession No. XP_504895), labeled as "yM1DP--3" in Figure |
| SwaI/BsiWI (4850-7020) | ALK2LM1::MaLPAAT1S::Pex20, comprising: ALK2LM1: *Yarrowia lipolytica* ALK2LM1 promoter plus N-terminal 66 bp coding region of *Y. lipolytica* AIK2 gene (SEQ ID NO: 93; U.S. Provisional Patent Appl. No. 61/471,746, filed Apr. 5, 2011 [Attorney Docket No. CL5381USPRV]); MaLPAAT1S: codon-optimized lysophosphatidic acid acyltransferase gene (SEQ ID NO: 19), derived from *Mortierella alpine* (U.S. Pat. No. 7,879,591); Pex20: Pex20 terminator sequence from *Yarrowia* Pex20 gene (GenBank Accession No. AF054613) |
| PmeI/SwaI (2342-4850) | DGAT2M::YID9::Lip1, comprising: DGAT2M: *Y. lipolytica* DGAT2M promoter (SEQ ID NO: 94; U.S. Provisional Patent Appl. No. 61/469,933, filed Mar. 31, 2011 [Attorney Docket No. CL4736USPRV]); YID9: *Y. lipolytica* delta-9 desaturase gene (labeled as "YID9DS" in Figure; GenBank Accession No. XM_501496.1; SEQ ID NO: 80); Lip1: Lip1 terminator sequence from *Yarrowia* Lip1 gene (GenBank Accession No. Z50020) |
| ClaII/PmeI (1-2342) | EXP1::YICPT1::OCT, comprising: EXP1: *Y. lipolytica* export protein (EXP1) promoter (labeled as "EXP" in Figure; Intl. App. Pub. No. WO 2006/052870); YICPT1: *Y. lipolytica* diacylglycerol cholinephosphotransferase gene (SEQ ID NO: 47; Intl. App. Pub. No. WO 2006/052870; GenBank Accession No. XM_501703); OCT: OCT terminator sequence of *Yarrowia* OCT gene (GenBank Accession No. X69988) |
| SalI/EcoRI (12871-11252) | *Yarrowia* Ura3 gene (GenBank Accession No. AJ306421) |

The pZKMP-ML9DCB plasmid was digested with AscI/SphI, and then used for transformation of strains L258U5 and L258U6, individually, according to the General Methods. The transformant cells were plated onto MM plates and maintained at 30° C. for 5 to 6 days. Single colonies were re-streaked onto MM plates, and then inoculated into liquid MM at 30° C. and shaken at 250 rpm/min for 2 days. The cells were collected by centrifugation, resuspended in HGM and then shaken at 250 rpm/min for 5 days. The cells were subjected to fatty acid analysis, according to the General Methods.

GC analyses showed that 21 of the selected 50 strains of L258U5 transformed with pZKMP-ML9DCB produced more than 50% EPA of TFAs. Two strains (i.e., #1, and #1B) that produced about 52.3% and 51.9% EPA of TFAs were designated as Z5585 and Z5627, respectively.

The final genotype of these pZKMP-ML9DCB transformant strains with respect to wildtype *Yarrowia lipolytica* ATCC #20362 was: Ura+, Pex3−, unknown 1−, unknown 2−, unknown 3−, unknown 4−, YALI0E12947g−, unknown 6−, YALI0B21890g−, unknown 8−, unknown 10−, unknown 11−, unknown 12−, unknown 13−, unknown 14−, YAT1::ME3S::Pex16, GPD::ME3S::Pex20, YAT1::ME3S::Lip1, FBAINm::EgD9eS::Lip2, EXP1::EgD9eS::Lip1, GPAT::EgD9e::Lip2, YAT1::EgD9eS::Lip2, YAT1::EgD9eS-L35G::Pex20, FBAINm::EgD8M::Pex20, EXP1::EgD8M::Pex16, FBAIN::EgD8M::Lip1, GPD::EaD8S::Pex16 (2 copies), YAT1::E389D9eS/EgD8M::Lip1, YAT1::EgD9eS/EgD8M::Aco, FBAINm::EaD9eS/EaD8S::Lip2, DGAT2M::YID9::Lip1, GPDIN::YID9::Lip1, GPD::FmD12::Pex20, YAT1::FmD12::Oct, EXP1::FmD12S::Aco, GPDIN::FmD12::Pex16, EXP1::EgD5M::Pex16, FBAIN::EgD5SM::Pex20, EXP1::EgD5SM::Lip1, YAT1::EaD5SM::Oct, FBAINm::PaD17::Aco, EXP1::PaD17::Pex16, YAT1::PaD17S::Lip1, YAT1::YICPT1::Aco, EXP1::YICPT1::OCT, YAT1::MCS::Lip1, FBA::MCS::Lip1, EXP1::YIPCT::Pex16, YAT1::MaLPAAT1S::Pex16, ALK2LM1::MaLPAAT1S::Pex20, FBAINm::YILPAAT1::Lip1 (2 copies), YAT1::YIPDAT::Lip1 (2 copies).

Knockout of the YALI0F02211g locus (GenBank Accession No. XP_504895) in strains Z5585 and Z5627 was not confirmed in any of these EPA strains, produced by transformation with pZKMP-ML9DCB.

Analysis of Total Lipid Content and Composition by Flask Assay

Cells from YPD plates of strains Z5585 and Z5627 were grown and analyzed for total lipid content and composition, according to the General Methods.

Table 7 within the Description Of Preferred Embodiments (supra) summarizes the DCW, the TFAs % DCW, the concentration of each fatty acid as a weight percent of TFAs ["% TFAs"] and the EPA % DCW of strains Z5585 and Z5627. Average DCW was 4.7 g/L, average TFAs % DCW was 54.3, average EPA % TFAs was 49.4, and average EPA % DCW was 26.8.

Example 8

Generation of *Yarrowia lipolytica* Strains YOS9607 And YOS9608, Producing at Least about 36 ETA % TFAs with at Least about 45 TFAs % DCW The present Example describes the construction of strains YOS9607 and YOS9608, derived from *Yarrowia lipolytica* strain Z5567 (Example 3), capable of producing more than 36 ETA % TFAs with more than 45 TFAs % DCW in flask assays. The original four delta-5 desaturase genes in strain Z5567 were deleted to result in strains YOS9607 and YOS9608, thus enabling production of ETA but without production of EPA.

Figure 9:
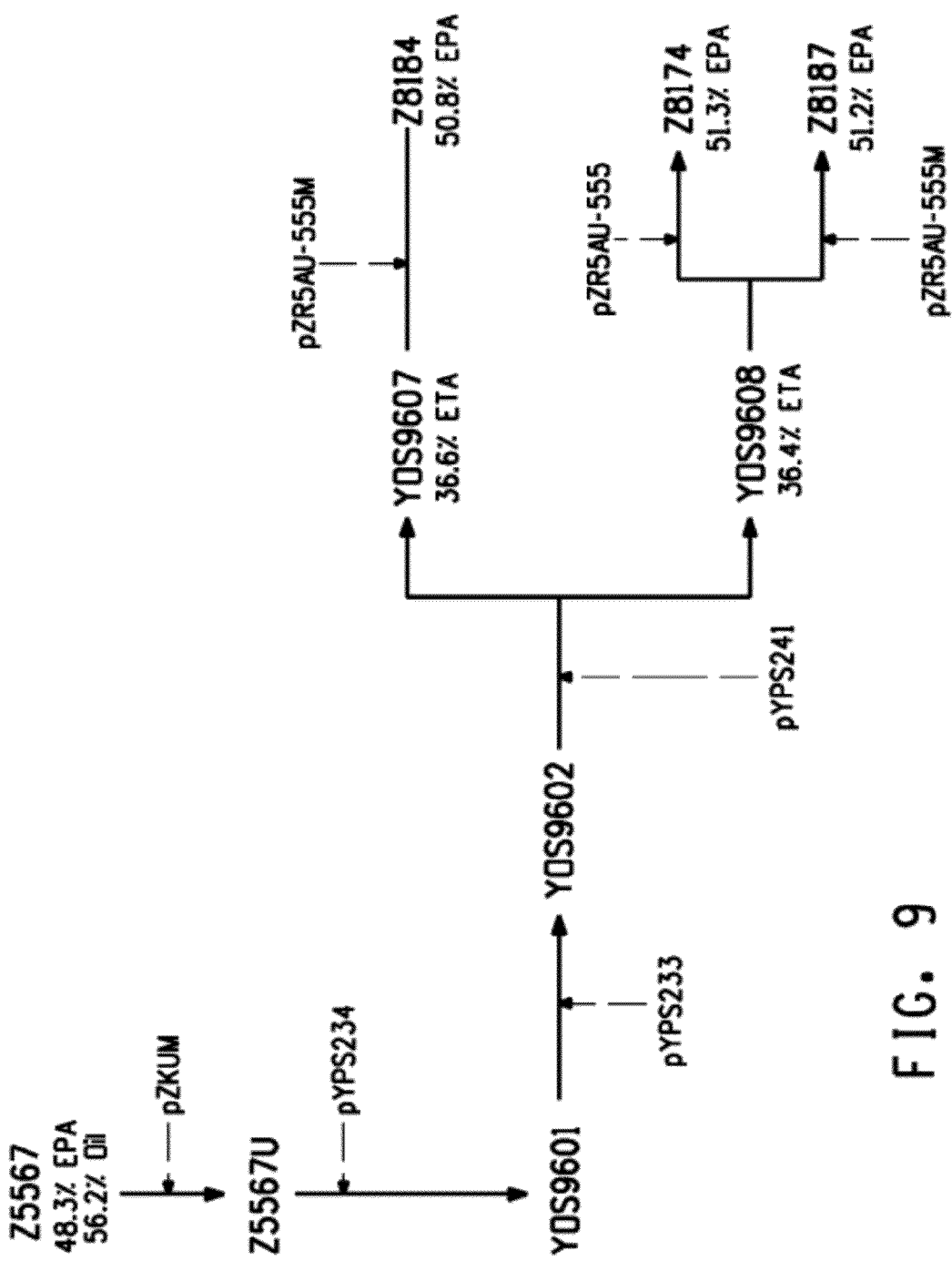

The development of strains YOS9607 and YOS9608 required the construction of intermediate strains Z5567U, YOS9601 and YOS9602 (FIG. 9).

Generation of Strain Z5567U (Ura3−)

To disrupt the Ura3 gene, construct pZKUM (FIG. 4A; SEQ ID NO:82; described in Table 15 of U.S. Pat. Appl. Pub. No. 2009-0093543-A1) was used to integrate an Ura3 mutant gene into the Ura3 gene of strain Z5567 in a manner similar to that described for pZKUM transformation of strain Y9502 (Example 1). A total of 19 transformants of group C were grown and identified to possess a Ura− phenotype.

GC analyses showed the presence of 36.9%, 37.0%, 35.6%, 36.8% and 36.0% EPA in the pZKUM-transformant strains #6, #11, #13, #15 and #16, grown on MM+5-FOA plates. These 5 strains were designated as Z5567U14, Z5567U19, Z5567U21, Z5567U23 and Z5567U24, respectively, collectively as Z5567U.

Generation of Strains YOS9607 and YOS9608

The four delta-5 desaturase genes in strain Z5567 were originally integrated into the chromosome from two different constructs: pZKSL-5S5A5 (FIG. 8A; SEQ ID NO:96) comprised chimeric EXP1::EgD5M::Pex16, FBAIN::EgD5SM::Pex20 and YAT1::EaD5SM::OCT genes, while pZP2-85m98F (FIG. 8B; SEQ ID NO:97) comprised the chimeric EXP1::EgD5SM::Lip1 gene. Three separate homologous recombination events were required to remove these chimeric genes.

First, the chimeric FBAIN::EgD5SM gene and a large portion of the Leu gene (i.e., from pZKSL-5S5A5) in the genome of strain Z5567U was replaced by homologous recombination (FIG. 10A) with a 993 bp stuffer DNA fragment (SEQ ID NO:98) within plasmid pYPS234 (FIG. 10B; SEQ ID NO:99), wherein the 993 bp stuffer comprised 5' and 3' portions of the *Yarrowia* carnitine/acyl carnitine carrier gene. More specifically, the pYSP234 plasmid contained the following components.

TABLE 15

Description of Plasmid pYPS234 (SEQ ID NO: 99)

| RE Sites And Nucleotides Within SEQ ID NO: 99 | Description Of Fragment And Chimeric Gene Components |
|---|---|
| SwaI/PacI (1-1498) | Ura3: *Yarrowia* Ura3 gene (GenBank Accession No. AJ306421) |
| 2494-3354 | Amp: Ampicillin-resistance gene for selection in *E. coli* |
| BsiWI/PmeI (4239-4964) | YAT1: *Y. lipolytica* YAT1 promoter (labeled as "YAT" in Figure; U.S. Pat. Appl. Pub. No. 2010-0068789-A1) |
| 4968-5320 | Leu fragment: 353 bp fragment of Leu2 gene (GenBank Accession No. AF260230) |
| 5327-6319 | 180 Stuffer: 993 bp DNA fragment (SEQ ID NO: 98), comprising 5' and 3' portions of *Yarrowia* carnitine/acyl carnitine carrier gene (GenBank Accession No XP_501358) |
| BamHI/ BsiWI | Pex20: Pex20 terminator sequence from *Yarrowia* Pex20 gene (GenBank Accession No. AF054613 |
| HindIII/SwaI (6638-7338) | Lys5-5': 720 bp 5' portion of *Yarrowia* Lys5 gene (GenBank Accession No. M34929; labeled as "lys5 5' region" in Figure) |

The first crossover event occurred within the Lys5-5' DNA fragment, while the second crossover event occurred within the YAT1 promoter region. Strain YOS9601 was generated from this homologous recombination, having a Leu− Ura− phenotype and three delta-5 desaturase genes in its genome.

Figure 11A:
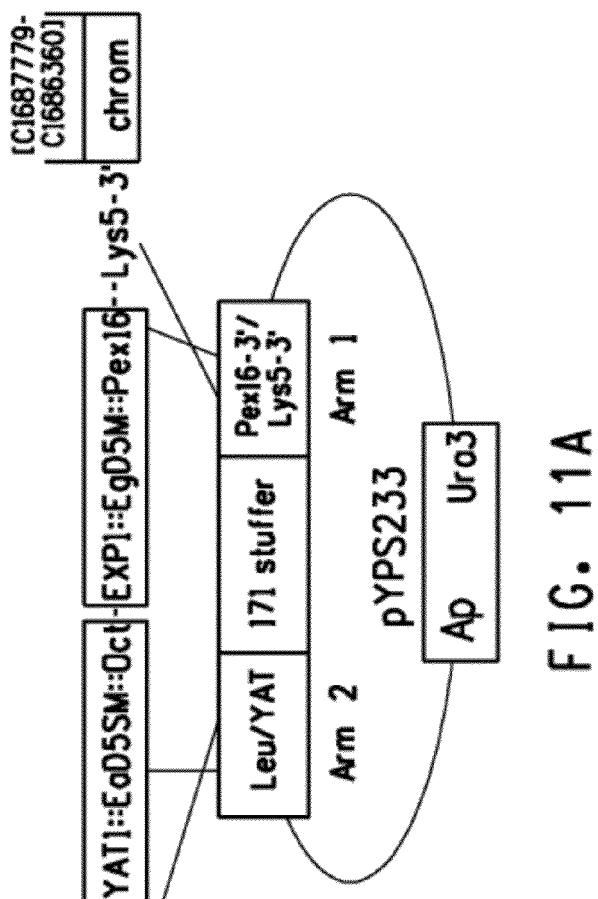
Figure 11B:
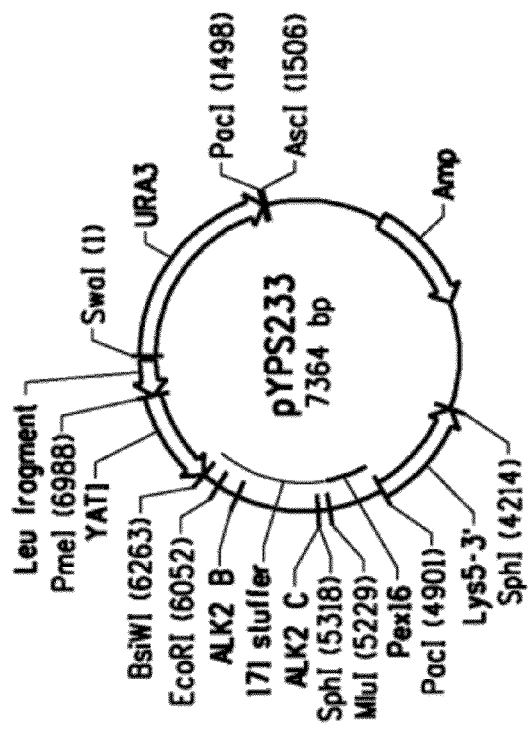

Then, the chimeric EXP1::EgD5M::Pex16 and YAT1::EaD5SM::OCT genes in the genome of strain YOS9601 were replaced by homologous recombination (FIG. 11A) with a 1019 bp stuffer DNA fragment (SEQ ID NO:100) within plasmid pYPS233 (FIG. 11B; SEQ ID NO:101), wherein the 1019 bp stuffer comprised 5' and 3' portions of the *Yarrowia* ALK2 gene. The pYSP233 plasmid contained the following components:

TABLE 16

Description of Plasmid pYPS233 (SEQ ID NO: 101)

| RE Sites And Nucleotides Within SEQ ID NO: 101 | Description Of Fragment And Chimeric Gene Components |
|---|---|
| Swa I/Pac I (1-1498) | Ura3: *Yarrowia* Ura3 gene (GenBank Accession No. AJ306421) |
| 2494-3354 | Amp: Ampicillin-resistance gene for selection in *E. coli* |
| Sph I/Pac I (4214-4901) | Lys5-3: 684 bp 3' portion of *Yarrowia* Lys5 gene (GenBank Accession No. M34929; labeled as "Lys5-3' region" in Figure) |
| Pac I/Mlu I (4904-5227) | Pex16: Pex16 terminator sequence from *Yarrowia* Pex16 gene (GenBank Accession No. U75433) |
| MluI/BsiWI (5229-6263) | 171 stuffer: 1019 bp DNA fragment (SEQ ID NO: 100), comprising 5' and 3' portions of the *Yarrowia* ALK2 gene (GenBank Accession No. BAA31434) |

TABLE 16-continued

Description of Plasmid pYPS233 (SEQ ID NO: 101)

| RE Sites And Nucleotides Within SEQ ID NO: 101 | Description Of Fragment And Chimeric Gene Components |
|---|---|
| BsiW I/ Pme I (6263-6988) | YAT1: *Y. lipolytica* YAT1 promoter (labeled as "YAT" in Figure; U.S. Pat. Appl. Pub. No. 2010-0068789-A1) |
| Pme I/Swa I (6988/1) | Leu fragment: 353 bp fragment of Leu2 gene (GenBank Accession No. AF260230) |

The first crossover event occurred within the Lys5-3' DNA fragment, while the second crossover event occurred within either the 3' Leu or YAT1 promoter region. Strain YOS9602 was generated from this homologous recombination, having a Leu− Ura− phenotype and one functional delta-5 desaturase gene remaining within the genome.

Figures 12A, 12B:
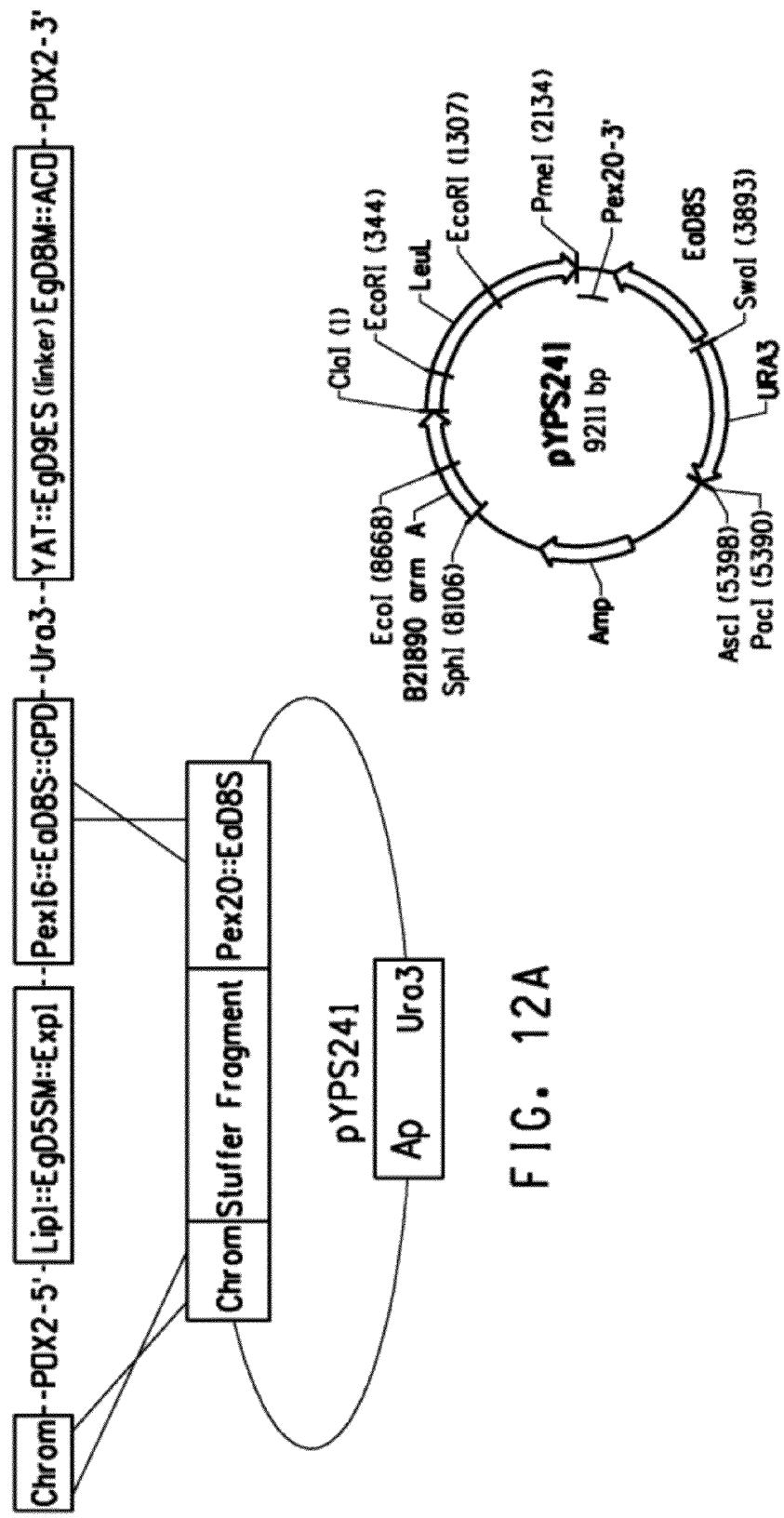

Finally, the chimeric EXP1::EgD5SM::Lip1 gene in the genome of strain YOS9602 was replaced by homologous recombination (FIG. 12A) with a functional Leu2 gene within plasmid pYSP241 (FIG. 12B; SEQ ID NO:102). The pYSP241 plasmid contained the following components:

TABLE 17

Description of Plasmid pYPS241 (SEQ ID NO: 102)

| RE Sites And Nucleotides Within SEQ ID NO: 102 | Description Of Fragment And Chimeric Gene Components |
|---|---|
| ClaI/SphI (1-2134) | LeuL: *Yarrowia* Leu2 gene encoding isopropylmalate dehydrogenase (GenBank Accession No. AF260230) |
| SwaI/PmeI (3893-2134) | EaD8S::Pex20, comprising: EaD8S: Synthetic delta-8 desaturase derived from *Euglena anabaena* (U.S. Pat. No. 7,789,156), codon-optimized for expression in *Y. lipolytica* ("EaD8S"; SEQ ID NO: 103); Pex20: Pex20 terminator sequence from Yarrowia Pex20 gene (GenBank Accession No. AF054613) |
| SphI/ClaI (8106-9209) | B21890 arm A: Upstream DNA sequence of *Yarrowia* ORF B21890 (GenBank Accession XP_501199). |
| SwaI/PacI (3893-5390) | Ura3: *Yarrowia* Ura3 gene (GenBank Accession No. AJ306421) |
| 6386-7246 | Amp: Ampicillin-resistance gene for selection in *E. coli* |

The first crossover event occurred in the region between position 2870148 and 2871250 of chromosome B, while the second crossover event occurred within the EaD8S region of plasmid pYSP241, thereby generating strains YOS9607 (Ura−) and YOS9608 (Ura−). Strains YOS9607 and YOS9608 (corresponding to two separate colonies having identical genotypes) were generated from this homologous recombination, each having a Ura− phenotype and no delta-5 desaturase genes within the genome.

The final genotype of YOS9607 and YOS9608 strains with respect to wildtype *Yarrowia lipolytica* ATCC #20362 was: Ura−, Pex3−, unknown 1−, unknown 2−, unknown 3−, unknown 4−, YALI0E12947g−, unknown 6−, YALI0B21890g−, unknown 8−, unknown 10−, unknown 11−, unknown 12−, unknown 13−, unknown 14−, YAT1::

ME3S::Pex16, GPD::ME3S::Pex20, YAT1::ME3S::Lip1, FBAINm::EgD9eS::Lip2, EXP1::EgD9eS::Lip1, GPAT:: EgD9e::Lip2, YAT1::EgD9eS::Lip2, YAT1::EgD9eS-L35G:: Pex20, FBAINm::EgD8M::Pex20, EXP1::EgD8M::Pex16, FBAIN::EgD8M::Lip1, YAT1::EgD8M::Pex20, GPD:: EaD8S::Pex16 (2 copies), YAT1::E389D9eS/EgD8M::Lip1, YAT1::EgD9eS/EgD8M::Aco, FBAINm::EaD9eS/EaD8S:: Lip2, GPDIN::YID9::Lip1, GPD::FmD12::Pex20, YAT1:: FmD12::Oct, EXP1::FmD12S::Aco, GPDIN::FmD12:: Pex16, FBAINm::PaD17::Aco, EXP1::PaD17::Pex16, YAT1::PaD17S::Lip1, YAT1::YICPT1::Aco, YAT1::MCS:: Lip1, FBA::MCS::Lip1 (2 copies), EXP1::YIPCT::Pex16, YAT1::MaLPAAT1S::Pex16 (2 copies), FBAINm::YIL-PAAT1::Lip1 (2 copies), YAT1::YIPDAT::Lip1 (2 copies).

To analyze the fatty acid composition and oil content of strains YOS9601 (Leu-, Ura-), YOS9602 (Leu-, Ura-), YOS9607 (Ura-), YOS9608 (Ura-) and the Z5567U (Ura-) control, triplicate flask assays were performed as set forth in the General Methods above.

Table 18 summarizes the total DCW, the TFAs % DCW, the concentration of each fatty acid as a weight percent of TFAs ["% TFAs"] and the EPA % DCW. Fatty acids are as in Table 7, while 20:4 (5,11,14,17) refers to juniperonic acid. The sum of all fatty acids in each sample totaled 100.

ity in strains YOS9607 (Ura-) and YOS9608 (Ura-) was validated by the total fatty acid analysis above; PCR analyses also confirmed the lack of any DNA sequence encoding a delta-5 desaturase gene. Compared with strain Z5567, the Z5567U (Ura-) strain produced less EPA % DCW in flask assays.

Example 9

Generation of *Yarrowia lipolytica* Strains Y8174, Y8184 And Y8187, Producing at Least about 50 EPA % TFAs with at Least about 49 TFAs % DCW The present Example describes construction of strains Y8174, Y8184 and Y8187, derived from *Yarrowia lipolytica* strains YOS9607 and YOS9608 (Example 8), capable of producing more than about 50 EPA % TFAs with more than 49 TFAs % DCW in flask assays. These strains were produced by integrating three double mutant delta-5 desaturases into the chromosome of strains YOS9607 (Ura-) and YOS9608 (Ura-), thereby restoring the ability of the transformant strains to produce EPA.

More specifically, the double mutant delta-5 desaturases which comprised mutations in both the HPGG [SEQ ID

TABLE 18

Fatty Acid Composition and Total Lipid Content In *Yarrowia* Strains YOS9601, YOS9602, YOS9607, YOS9608 And Z5567U

| Strain (# of Delta-5 Desaturase Genes) | Sample | % TFAs | | | | | | | | | | | | | |
|---|---|---|---|---|---|---|---|---|---|---|---|---|---|---|---|
| | | 16:0 | 16:1 | 18:0 | 18:1 | 18:2 | ALA | EDA | DGLA | ARA | EtrA | 20:4 (5, 11, 14, 17) | ETA | EPA | Other |
| Z5567U (4 delta-5 genes) | A | 2.2 | 1.0 | 2.9 | 9.8 | 15.5 | 0.5 | 6.9 | 5.3 | 0.7 | 1.4 | 0.5 | 3.7 | 42.2 | 7.3 |
| | B | 2.2 | 1.0 | 3.0 | 9.9 | 15.6 | 0.6 | 6.9 | 5.2 | 0.7 | 1.4 | 0.5 | 3.7 | 42.0 | 7.3 |
| | C | 2.2 | 1.0 | 2.9 | 10.0 | 15.4 | 0.5 | 6.9 | 5.3 | 0.7 | 1.3 | 0.5 | 3.6 | 42.2 | 7.4 |
| | Avg | 2.2 | 1.0 | 2.9 | 9.9 | 15.5 | 0.5 | 6.9 | 5.2 | 0.7 | 1.4 | 0.5 | 3.7 | 42.1 | 7.4 |
| YOS9601 (3 delta-5 genes) | A | 4.0 | 1.5 | 4.2 | 14.0 | 17.3 | 0.5 | 7.6 | 5.5 | 0.5 | 1.5 | 0.3 | 4.0 | 33.0 | 5.9 |
| | B | 3.8 | 1.4 | 4.0 | 13.7 | 17.4 | 0.6 | 7.6 | 5.6 | 0.5 | 1.5 | 0.4 | 4.1 | 33.4 | 6.0 |
| | C | 3.8 | 1.4 | 4.1 | 13.7 | 17.4 | 0.6 | 7.5 | 5.6 | 0.5 | 1.6 | 0.4 | 4.1 | 33.4 | 5.9 |
| | Avg | 3.9 | 1.5 | 4.1 | 13.8 | 17.4 | 0.6 | 7.5 | 5.6 | 0.5 | 1.5 | 0.4 | 4.1 | 33.2 | 6.0 |
| YOS9602 (1 delta-5 gene) | A | 3.5 | 1.4 | 3.7 | 12.4 | 16.9 | 0.6 | 7.9 | 8.2 | 0.4 | 1.6 | 0.3 | 7.1 | 30.3 | 5.9 |
| | B | 3.4 | 1.4 | 3.7 | 12.2 | 16.9 | 0.5 | 8.0 | 8.3 | 0.5 | 1.6 | 0.2 | 7.1 | 30.4 | 5.9 |
| | C | 3.5 | 1.4 | 3.8 | 12.4 | 16.8 | 0.5 | 7.9 | 8.2 | 0.5 | 1.5 | 0.3 | 7.0 | 30.2 | 6.0 |
| | Avg | 3.5 | 1.4 | 3.7 | 12.3 | 16.8 | 0.5 | 7.9 | 8.3 | 0.5 | 1.6 | 0.3 | 7.1 | 30.3 | 5.9 |
| YOS9607 (zero delta-5 genes) | A | 3.0 | 1.7 | 2.6 | 11.4 | 14.3 | 0.5 | 8.5 | 15.2 | 0.2 | 1.6 | 0.4 | 36.6 | 0.0 | 4.1 |
| | B | 3.0 | 1.7 | 2.6 | 11.4 | 14.3 | 0.5 | 8.5 | 15.2 | 0.1 | 1.6 | 0.4 | 36.7 | 0.0 | 4.1 |
| | C | 3.0 | 1.7 | 2.6 | 11.4 | 14.3 | 0.5 | 8.6 | 15.2 | 0.1 | 1.6 | 0.4 | 36.6 | 0.0 | 4.1 |
| | Avg | 3.0 | 1.7 | 2.6 | 11.4 | 14.3 | 0.5 | 8.5 | 15.2 | 0.1 | 1.6 | 0.4 | 36.6 | 0.0 | 4.1 |
| YOS9608 (zero delta-5 genes) | A | 3.1 | 1.7 | 2.6 | 11.5 | 14.0 | 0.5 | 8.6 | 15.4 | 0.2 | 1.6 | 0.4 | 36.3 | 0.0 | 4.2 |
| | B | 3.1 | 1.7 | 2.6 | 11.5 | 14.1 | 0.5 | 8.7 | 15.3 | 0.2 | 1.6 | 0.4 | 36.4 | 0.0 | 4.1 |
| | C | 3.1 | 1.7 | 2.6 | 11.4 | 14.1 | 0.5 | 8.6 | 15.3 | 0.1 | 1.6 | 0.4 | 36.6 | 0.0 | 4.0 |
| | Avg | 3.1 | 1.7 | 2.6 | 11.5 | 14.1 | 0.5 | 8.6 | 15.3 | 0.2 | 1.6 | 0.4 | 36.4 | 0.0 | 4.1 |

The data of the flask experiment demonstrated that strain YOS9601 (Leu-, Ura-), comprising three delta-5 desaturase genes within the genome, produced about 33 EPA % TFAs, while strain YOS9602 (Leu-Ura-), comprising only one delta-5 desaturase gene in its genome, produced about 30 EPA % TFAs. In contrast, strains YOS9607 (Ura-) and YOS9608 (Ura-) were not able to produce any EPA but did produce about 36% ETA. The lack of delta-5 desaturase activ- NO:181] and HDASH [SEQ ID NO:183] motifs (as described in U.S. Provisional Application No. 61/428,277 [filed Dec. 30, 2010], hereby incorporated herein by reference), were selected from the group consisting of: EgD5S-36s157g (SEQ ID NO:110; Example 1114 EaD5S-35a158g (SEQ ID NO:112; Example 11M), EgD5M (i.e., EgD5R*-34g158g; SEQ ID NO:106; Examples 11I and 11K) and EgD5M1 (i.e., EgD5R*-34g158g347s; SEQ ID NO:108; Examples 11J and 11K).

Construct pZR5AU-555 (FIG. 13A; SEQ ID NO:113) was generated to integrate three chimeric mutant delta-5 desaturase genes (i.e., FBAIN::EgD5S-36s157g::Pex20, YAT1::EaD5S-35a158g::Oct, and EXP1::EgD5M (EgD5R-34g158g))::Pex16 into the region between 1685392 and 1687267 of chromosome C of strain YOS9607 and YOS9608, to thereby enable production of EPA.

The pZR5AU-555 plasmid contained the following components:

TABLE 19

Description of Plasmid pZR5AU-555 (SEQ ID NO: 113)

| RE Sites And Nucleotides Within SEQ ID NO: 113 | Description Of Fragment And Chimeric Gene Components |
|---|---|
| AscI/BsiWI (7713-6820) | 890 bp DNA fragment between 1685392 and 1686281 of Yarrowia chromosome C (labeled as "R5-5' region" in Figure) |
| PacI/AscI (11396-10436) | 967 bp DNA fragment between 1686300 and 1687260 of Yarrowia chromosome C (labeled as "R5-3' region" in Figure) |
| PmeI/ClaI (2476-1) | YAT1::EaD5S-35a158g::Oct, comprising: YAT1: Yarrowia lipolytica YAT1 promoter (labeled as "YAT" in Figure; U.S. Pat. Appl. Pub. No. 2010-0068789-A1); EaD5S-35a158g: Synthetic mutant delta-5 desaturase (SEQ ID NO: 111) comprising mutant HaGG [SEQ ID NO: 428] and HDgSH [SEQ ID NO: 429] motifs, derived from Euglena anabaena; OCT: OCT terminator sequence of Yarrowia OCT gene (GenBank Accession No. X69988) |
| EcoRII/BsiWI (4127-6820) | FBAIN::EgD5S-36s157g::Pex20, comprising: FBAIN: Y. lipolytica FBAIN promoter (labeled as "FBA1 + Intron" in Figure; U.S. Pat. No. 7,202,356); EgD5S-36s157g: Synthetic mutant delta-5 desaturase (SEQ ID NO: 109) comprising mutant HPGs [SEQ ID NO: 427] and HDgSH [SEQ ID NO: 429] motifs, derived from E. gracilis (labeled as "EgD5S" in Figure, with mutant HPGs and HDgSH motifs shown); Pex20: Pex20 terminator sequence from Yarrowia Pex20 gene (GenBank Accession No. AF054613) |
| PacI/ClaI (11396-1) | EXP1::EgD5M (EgD5R-34g158g)::Pex16, comprising: EXP1: Y. lipolytica export protein (EXP1) promoter (labeled as "EXP" in Figure; WO 2006/052870); EgD5M (EgD5R*-34g158g): Synthetic mutant delta-5 desaturase (SEQ ID NO: 105) comprising mutant HgGG [SEQ ID NO: 425] and HDAgH [SEQ ID NO: 432] motifs, derived from E. gracilis (labeled as "EgD5M" in Figure, with mutant HgGG and HDAgH motifs shown); |

TABLE 19-continued

Description of Plasmid pZR5AU-555 (SEQ ID NO: 113)

| RE Sites And Nucleotides Within SEQ ID NO: 113 | Description Of Fragment And Chimeric Gene Components |
|---|---|
| | Pex16: Pex16 terminator sequence from Yarrowia Pex16 gene (GenBank Accession No. U75433) |
| PmeI/EcoRI (2476-4127) | Yarrowia Ura3 gene (GenBank Accession No. AJ306421) |

Construct pZR5AU-555M (FIG. 13B; SEQ ID NO:114) was identical to pZR5AU-555, with the exception that the chimeric EXP1::EgD5M1 (EgD5-34g158g347s)::Pex16 gene was used in place of the chimeric EXP1::EgD5M (EgD5R-34g158g)::Pex16 gene of pZR5AU-555 (i.e., wherein EgD5-34g158g347s is set forth in SEQ ID NO:107).

The pZR5AU-555 and pZR5AU-555M plasmids were digested separately with AscI and then used for transformation of strains YOS9607 and YOS9608 individually, according to the General Methods. The transformant cells were plated onto MM plates and maintained at 30° C. for 5 days. Single colonies were re-streaked onto MM plates and subsequently inoculated into liquid MM at 30° C. and shaken at 250 rpm/min for 2 days. The cells were collected by centrifugation, resuspended in HGM and then shaken at 250 rpm/min for 5 days. The cells were subjected to fatty acid analysis, according to the General Methods.

GC analyses of 96 pZR5AU-555m transformants into strain YOS9607 identified one strain (i.e., #86) that produced 50.8% EPA of TFAs; this strain was designated as strain Z8184. Similarly, screening of 96 pZR5AU-555 transformants into strain YOS9608 identified one strain (i.e., #68) that produced 51.3% EPA of TFAs; this strain was designated as strain Z8174. And, GC analyses of 96 pZR5AU-555m transformants into strain YOS9608 identified one strain (i.e., #56) that produced 51.2% EPA of TFAs; this strain was designated as strain Z8187.

Fatty acid composition and oil content of these new EPA strains were determined by conducting duplicate flask assays. Table 20 summarizes the total DCW, the TFAs % DCW, the concentration of each fatty acid as a weight percent of TFAs ["% TFAs"] and the EPA % DCW. Fatty acids are identified as in Table 7 (supra), while 20:4 (5,11,14,17) refers to juniperonic acid. The sum of all fatty acids in each sample totaled 100.

Thus, all 3 strains were capable of producing greater than 50 EPA % TFAs, with greater than 49 TFAs % DCW.

TABLE 20

Fatty Acid Composition and Total Lipid Content In Yarrowia Strains Z8174, Z8184 And Z8187

| | | | % TFAs | | | | | | | | | | | | |
|---|---|---|---|---|---|---|---|---|---|---|---|---|---|---|---|
| Strain | DCW (g/L) | TFAs % DCW | 16:0 | 16:1 | 18:0 | 18:1 | 18:2 | ALA | EDA | DGLA | ARA | EtrA | 20:4 (5, 11, 14, 17) | ETA | EPA | EPA % DCW |
| Z8174 | 4.4 | 49.7 | 2.1 | 0.8 | 2.2 | 5.8 | 14.8 | 0.7 | 3.6 | 6.2 | 0.8 | 0.6 | 0.5 | 4.1 | 50.9 | 25.3 |
| Z8184 | 4.5 | 51.6 | 2.1 | 0.8 | 2.1 | 5.8 | 14.9 | 0.7 | 3.7 | 6.6 | 0.7 | 0.5 | 0.2 | 4.1 | 50.8 | 26.2 |
| Z8187 | 4.3 | 50.8 | 2.1 | 0.8 | 2.1 | 5.6 | 14.8 | 0.7 | 3.9 | 6.6 | 0.8 | 0.6 | 0.3 | 4.2 | 50.7 | 25.7 |

Example 10

Mutant Delta-9 Elongases Having Improved Linoleic Acid to Eicosadienoic Acid Conversion Efficiency The present Example, set forth in parts herein as Examples 10A, 10B, 10C, 10D, 10E, 10F, 10G, 10H, 10I and 10J, sets forth experimental data to support the description of a mutant delta-9 elongase polypeptide comprising an amino acid sequence as set forth in SEQ ID NO:1, wherein SEQ ID NO:1 differs from SEQ ID NO:3 by at least one amino acid mutation, said mutation(s) selected from the group consisting of: (i) a L35F mutation; (ii) a L35M mutation; (iii) a L35G mutation; (iv) a L35G mutation and at least one other mutation selected from the group consisting of: S9A, S9D, S9G, S9I, S9K, S9Q, Q12K, A21D, A21T, A21V, V32F, Y84C, Q107E, L108G, G127L, W132T, M143N, M143W, L161T, L161Y, W168G, I179M, I179R, C236N, Q244N, A254W and A254Y; (v) L35G, A21V, L108G and I179R mutations; (vi) L35G, W132T and I179 mutations; (vii) L35G, S9D, Y84C and I179R mutations; (viii) L35G, Y84C, I179R and Q244N mutations; (ix) L35G, A21V, W132T, I179R and Q244N mutations; (x) K58R and I257T mutations; (xi) a D98G mutation; (xii) L130M and V243A mutations; and, (xiii) any combination comprising at least two mutations, wherein the mutations are selected from the group consisting of: K58R, L35F, L35G, L35M, S9A, S9D, S9G, S9I, S9K, S9Q, Q12K, A21D, A21T, A21V, V32F, Y84C, D98G, Q107E, L108G, G127L, L130M, W132T, M143N, M143W, L161T, L161Y, W168G, I179M, I179R, C236N, V243A, Q244N, A254W, A254Y and I257T. Examples 10A, 10B, 10C, 10D, 10E, 10F, 10G, 10H, 10I and 10J are also set forth in U.S. Provisional Patent Application No. 61/377,248 [filed Aug. 26, 2010, incorporated herein by reference in its entirety.

Example 10A

Construction of *Yarrowia lipolytica* Expression Vector pZuFmEgD9ES, Comprising a Synthetic Delta-9 Elongase Gene (Derived from *Euglena gracilis*), Codon-Optimized for Expression in *Yarrowia lipolytica* ["EgD9eS"]

Figure 14:
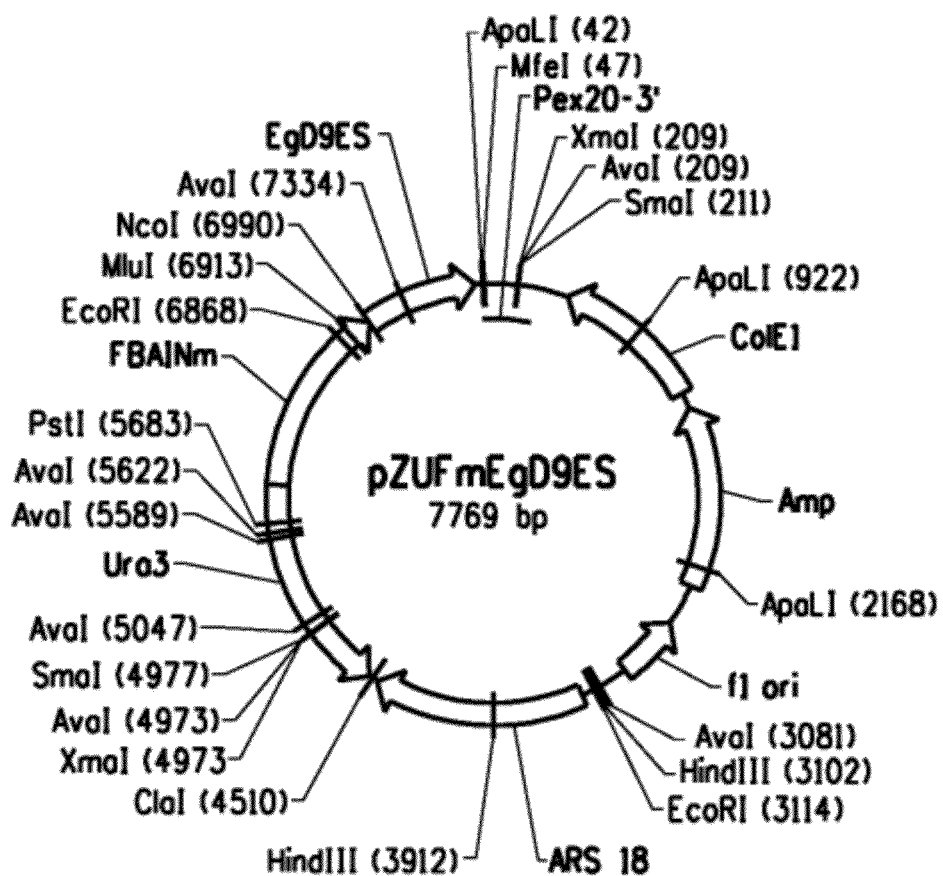

The construction of *Yarrowia lipolytica* vector pZuFmEgD9ES (FIG. 14; SEQ ID NO:115), comprising a chimeric FBAINm::EgD9eS::Pex20 gene, wherein EgD9eS is a synthetic delta-9 elongase derived from *Euglena gracilis* and codon-optimized for expression in *Yarrowia*, is described in Example 8 of U.S. Pat. No. 7,645,604, hereby incorporated herein by reference. The nucleotide sequence of EgD9eS (SEQ ID NO:2) differs from the nucleotide sequence of the wild type *Euglena gracilis* delta-9 elongase ("EgD9e"; SEQ ID NO:31), since 117 bp of the 777 bp coding region were modified (15.1%) and 106 codons were optimized (40.9%), in addition to modification of the translation initiation site (yet the protein sequence encoded by the codon-optimized gene [i.e., SEQ ID NO:3] is identical to that of the wildtype protein sequence [i.e., SEQ ID NO:32]).

Example 10B

Generalized Method for Analyzing *Yarrowia lipolytica* Transformants Comprising Mutant Delta-9 Elongases with Increased Delta-9 Elongase Conversion Efficiency The present Example describes generalized means to analyze lipid profiles within pZUFmEgD9ES transformants of *Yarrowia lipolytica* strain Y2224 (a FOA resistant mutant from an autonomous mutation of the Ura3 gene of wildtype *Yarrowia* strain ATCC #20362 [isolation described in Example 7 of Intl. App. Pub. No. WO 2008/073367]), expressing either the non-mutant EgD9eS gene (SEQ ID NO:2 (referred to as either the "control" or "wildtype") or various mutated EgD9eS genes, created in error prone polymerase chain reaction ["ePCR"] libraries (Example 10C), site-saturation libraries (Example 10E), SlonoMax® libraries (Example 10G), or combinatorial libraries (Example 10I) (described infra).

Transformation of Mutant Libraries into *Escherichia coli* and *Yarrowia lipolytica*

Plasmids from each mutant library were transformed into *E. coli* Top 10 electro-competent cells (Cat. No. C404052, Invitrogen, Carlsbad, Calif.) by electroporation. The transformed cells were spread onto Luria-Bertani ["LB"] agar plates with 100 mg/L ampicillin and grown in a 37° C. incubator overnight. Plasmid DNA was extracted from the *E. coli* transformants using a QIAprep® Spin Miniprep kit (Qiagen Inc., Valencia, Calif.) following the manufacturer's protocol.

The DNA molecules were then transformed into *Y. lipolytica* strain Y2224 as described in the General Methods, and the transformants were selected on MM plates. After 2 days growth at 30° C., transformants selected on MM plates were picked and re-streaked onto fresh MM plates.

Quick Screen Plate Assay

A quick screen "plate assay" was used for the preliminary functional analysis of each mutant library. For this plate assay, *Y. lipolytica* transformants from the re-streaked MM plates above were analyzed directly from the media plate. FAMEs were prepared using trimthylsulphonium hydroxide ["TMSH"].

The TMSH was prepared from trimethylsulfonium iodide ["TMSI"], after conversion to a solution of the hydroxide by reaction with silver oxide in methanol. Specifically, 4.4 g TMSI were mixed in 100 mL MeOH and allowed to incubate in a 50° C. water bath for 1 hr; then, 5g $Ag_2O$ were added to the solution and stirred for 4 hr at room temperature. The final solution was filtered before use. TMSH causes base-catalyzed transesterification of O-acyl lipids (i.e., TAG) and esterification of free fatty acids (A. H. El-Hamdy & W. W. Christie, *J. of Chromatography*, 630:438-441 (1993)).

Using a 1 µl loop, cells were taken directly from the re-streaked MM plate and suspended in 50 µl TMSH in a gas chromatogram ["GC"] vial with a 0.35 mL insert. Heptane (150 µl) was then added to the vial insert, the vial was capped and then incubated for 20 min at room temperature with agitation. Subsequently, 1 µl from the heptane layer was injected into a Hewlett Packard 7890 GC fitted with an Omegawax 320 fused silica capillary column (Supelco Inc., Bellefonte, Pa.) for GC analysis of FAMEs. Retention times were compared to those for methyl esters from commercial standards (Standard #461, Nu-Chek Prep, Inc., Elysian, Minn.).

The FAME profiles obtained from cells comprising the EgD9eS mutants were compared to that of the non-mutant EgD9eS control. The results of this primary screen served as the basis for the selection of mutants that were subjected to the secondary confirmation assay. The criteria used to select mutants for the confirmation assay was based on the lipid profile, in particular the concentration of EDA as calculated from the GC peak area of the corresponding FAME as a percent relative to the sum of all integrated peaks ["EDA % TFAs"] and/or the conversion efficiency of LA to EDA. The conversion efficiency ["% Conv"] of LA to EDA was calculated for each transformant according to the following formula: ([product]/[substrate+product])*100, wherein the product was EDA % TFAs and the substrate was the concentration of LA as an area percent of TFAs ["LA % TFAs"].

"Confirmation" Assay

EgD9eS mutants that demonstrated improvement in delta-9 elongation activity relative to the control via the quick screen "plate assay" were selected for subsequent confirmation assays.

*Y. lipolytica* transformants comprising EgD9eS mutants were first re-streaked on MM plates and then each individual transformant was inoculated into triplicate cultures of 3 mL liquid MM at 30° C., shaken at 250 rpm/min for 2 days. The cells were collected by centrifugation, lipids were extracted, and FAMEs were prepared by transesterification of the lipid extract with sodium methoxide (Roughan, G., and Nishida I., *Arch. Biochem. Biophys.*, 276(1):38-46 (1990)) and subsequently analyzed by GC, as described for the plate assay (supra).

Following confirmation of improved delta-9 elongation activity, each mutant pZUFmEgD9ES plasmid was recovered from the *Y. lipolytica* strain Y2224 transformants, using the Zymoprep™ Yeast Plasmid Miniprep II kit (Cat. No. D2004, Zymo Research, Orange, Calif.), as recommended by the manufacturer.

The rescued plasmids were sequenced on an ABI Automatic sequencer using dye terminator technology (U.S. Pat. No. 5,366,860; EP 272,007) with vector and insert-specific primers. Comparisons of sequences were accomplished using standard tools well known in the art.

Example 10C

Construction of Two EgD9eS Error Prone PCR Libraries

The present Example describes the synthesis of two delta-9 elongase error prone polymerase chain reaction ["ePCR"] libraries. The two ePCR libraries were created in a two-step method that first required the generation of a suite of megaprimers comprising random mutations within the templates, followed by the use of these megaprimers to make point mutations into pZuFmEgD9ES. The construct pZuFmEgD9ES (SEQ ID NO:115) (Example 10A) was used as the DNA template for the first ePCR library. The second ePCR library used hits from screening of the first ePCR library as DNA templates.

Creation of Megaprimers Using a Random Mutagenesis Kit

The GeneMorph II Random Mutagenesis Kit (Cat. No. 200550, Stratagene, La Jolla, Calif.) was used to create random amino acid substitutions in the target protein. It functions by introducing mutations into the target gene during error-prone PCR using a novel error prone PCR enzyme blended formation comprising a combination of two different polymerases to produce a less biased mutational spectrum with equivalent mutation rates at A's and T's versus G's and C's. It is advertised that mutation rates of 1-16 mutations per kB can be achieved using a single set of buffer conditions optimized for high product yield. The desired mutation rate can be controlled simply by varying the initial amount of template DNA in the reaction and/or the number of amplification cycles performed.

The above kit was utilized to generate EgD9eS "megaprimers", using the protocol recommended by the manufacturer. These megaprimers were about 930 bp long and comprised the 777 bp encoding EgD9eS (SEQ ID NO:2). The reaction mixture contained either 16 ng of DNA template per μl for the first ePCR library or 2.0 ng of DNA template per μl for the second library. It also comprised reaction buffer, dNTPs (0.8 mM), primer pZUFm_6980_012208f (SEQ ID NO:116) (2 μM), primer pZUFm_40_012208r (SEQ ID NO:117) (2 μM) and Mutazyme® II DNA polymerase (0.25 U/μl). The PCR reaction was performed in a thin well 200 μl tube in Mastercycler gradient equipment (Brinkmann Instruments, Inc., Westbury, N.Y.). PCR amplification was performed using the following conditions: 95° C. for 2 min, followed by 30 cycles of denaturation at 95° C. for 30 sec, annealing at 55° C. for 30 sec, and elongation at 72° C. for 90 sec. A final elongation cycle at 72° C. for 4 min was carried out, followed by reaction termination at 4° C.

The PCR products were purified using a DNA Clean & Concentrator™-5 kit (Cat. No. D4003, Zymo Research, Orange, Calif.), as recommended by the manufacturer. The purified double-stranded PCR products were utilized as "megaprimers", each containing various mutations within EgD9eS.

Standard Cloning Methods To Create ePCR Mutant Genes Of EgD9eS

For the first ePCR library, "megaprimers" were digested with NcoI and NotI restriction enzymes. The gel purified NcoI/NotI gene fragment was then directly ligated into gel purified NcoI/NotI pZUFmEgD9ES vector (SEQ ID NO:115) using T4 DNA ligase (Promega, Madison, Wis.), via a ligation reaction at room temperature for 5 hr.

Site-Directed Mutagenesis to Create ePCR Mutant Genes of EgD9eS

To create the second ePCR library, the "megaprimers" described above were utilized in reactions designed to introduce the EgD9eS mutations within the "megaprimers" into pZuFmEgD9ES (FIG. 14; SEQ ID NO:115), thereby replacing the non-mutant EgD9eS gene with various mutant EgD9eS genes. This was accomplished using the QuikChange® II XL site directed mutagenesis kit (Cat. No. 200524, Stratagene, La Jolla, Calif.).

The QuikChange® II site-directed mutagenesis kit is used to make point mutations, replace amino acids, and delete or insert single/multiple adjacent amino acids within an insert of interest in a double-stranded vector, using the high-fidelity PfuUltra DNA polymerase for mutagenic primer-directed replication of both plasmid strands. The kit requires no specialized vectors, unique restriction sites, or multiple transformations and allows site-specific mutation in virtually any double-stranded plasmid. The basic procedure utilizes two synthetic oligonucleotide primers, both containing the desired mutation and complementary to opposite strands of the vector, which are extended during temperature cycling by the high-fidelity DNA polymerase without primer displacement. Extension of the oligonucleotide primers generates a mutated plasmid containing staggered nicks, which is then treated with the Dpn I endonuclease. This restriction enzyme is specific for methylated and hemi-methylated DNA, thereby allowing digestion of the parental DNA template and selection for mutation-containing synthesized DNA. The nicked vector DNA containing the desired mutations is then transformed and propagated in an *Escherichia coli* host.

In the present methodology, however, the double-stranded megaprimers comprising various mutant EgD9eS genes were used in place of traditional synthetic oligonucleotide primers. Specifically, a 50 μl reaction was prepared comprising 5.0 μl of 10× kit-supplied reaction buffer, 1.0 μl of 50 ng/0 pZUFmEgD9ES template (SEQ ID NO:115), 42 μl megaprimer, 1.0 μl of 40 mM kit-supplied dNTP mix and 1.0 μl kit-supplied Pfu-Ultra DNA polymerase. This reaction mixture was placed in a thin well 200 μl-capacity PCR tube and subjected to PCR amplification, using the following conditions: 95° C. for 30 sec, followed by 25 cycles of denaturation at 95° C. for 30 sec, annealing at 55° C. for 1 min, and elongation at 68° C. for 6 min. A final elongation cycle at 68° C. for 8 min was carried out, followed by reaction termination at 4° C.

Kit-supplied DpnI restriction enzyme (1.0 μl) was directly added to the finished site-directed mutagenesis reaction mixture and enzymatic digestion was performed at 37° C. for 1 hr to remove the DNA template. The digested product was purified using a DNA cleaning kit (Zymo Research) and eluted to yield 10 μl of purified DNA, comprising various mutant EgD9eS genes contained within the pZUFmEgD9ES vector backbone.

Example 10D

Identification of ePCR EgD9eS Library Mutants Having Improved Delta-9 Elongase Conversion Efficiency The present Example describes: 1) the identification of EgD9eS ePCR library mutants having improved delta-9 elongase conversion efficiency of LA to EDA, as compared to that of the wildtype protein EgD9eS (SEQ ID NO:3); and, 2) sequence analysis of these EgD9eS ePCR library mutants.

Identification of EgD9eS ePCR Mutants

The ePCR gene library mutants prepared in Example 10C were transformed into E. coli Top 10 electro-competent cells, purified and subsequently transformed into Y. lipolytica strain Y2224, as described in Example 10B. The fatty acid profiles of 1,724 Yarrowia transformants were screened using the quick screen "plate assay" of Example 10B. Most of these mutants exhibited reduced activity compared to the control. However, five transformants were confirmed to exhibit improved delta-9 elongation activity as compared to the control, based on confirmation assays of Example 10B.

Data from two independent confirmation assays are presented in Table 21 and Table 22, and the FAME profiles of individual pZuFmEgD9ES control transformants are compared with those of ePCR mutants. More specifically, the concentration of each fatty acid as calculated from the GC peak area of the corresponding FAME as a percent relative to the sum of all integrated peaks ["% TFAs"] and % Conv. of LA to EDA (determined as described in Example 10B) for each strain is shown below in Table 21 and Table 22, while averages are highlighted in gray and indicated with "Avg". Fatty acids are identified as 16:0 (palmitic acid), 16:1 (palmitoleic acid), 18:0 (stearic acid), 18:1 (oleic acid), LA and EDA. Comparison of each mutant's performance relative to the EgD9eS control should only be made within the particular confirmation assay in which each mutant was analyzed (i.e., comparisons can not be made between Assay #1 and Assay #2).

TABLE 21

Confirmation Assay #1: Lipid Composition In Transformant Y. lipolytica Strain Y2224, Expressing EgD9eS Or ePCR Library Mutant Variants Thereof

| Strain | Replicate No. | % TFAs | | | | | | % Conv LA to EDA |
|---|---|---|---|---|---|---|---|---|
| | | 16:0 | 16:1 | 18:0 | 18:1 | LA | EDA | |
| EgD9eS Control-1 | 1 | 12.8 | 12.9 | 3.0 | 46.6 | 17.3 | 3.0 | 14.8 |
| | 2 | 12.9 | 12.6 | 3.0 | 45.5 | 17.2 | 3.1 | 15.2 |
| | 3 | 12.6 | 12.5 | 2.9 | 47.0 | 17.1 | 3.1 | 15.3 |
| EgD9eS Control-2 | 1 | 14.0 | 12.4 | 3.6 | 45.6 | 16.2 | 3.2 | 16.3 |
| | 2 | 12.2 | 12.5 | 2.6 | 47.4 | 17.3 | 3.1 | 15.1 |
| | 3 | 13.2 | 13.1 | 3.1 | 45.4 | 17.2 | 3.1 | 15.3 |
| EgD9eS Control-3 | 1 | 13.3 | 13.2 | 3.1 | 45.0 | 17.2 | 3.2 | 15.7 |
| | 2 | 12.8 | 12.6 | 2.9 | 46.5 | 17.3 | 3.1 | 15.0 |
| | 3 | 13.2 | 13.0 | 3.1 | 45.3 | 17.2 | 3.2 | 15.7 |
| EgD9eS Control-4 | 1 | 13.7 | 11.9 | 3.7 | 46.2 | 15.8 | 3.4 | 17.6 |
| | 2 | 12.6 | 13.0 | 2.7 | 45.5 | 17.9 | 3.2 | 15.3 |
| | 3 | 12.7 | 12.9 | 2.9 | 45.6 | 17.6 | 3.2 | 15.5 |
| EgD9eS Control-5 | 1 | 12.9 | 12.6 | 3.0 | 45.7 | 17.7 | 3.1 | 14.9 |
| | 2 | 12.1 | 12.1 | 2.7 | 47.9 | 17.3 | 3.1 | 15.2 |
| Avg. Control | — | 12.9 | 12.7 | 3.0 | 46.1 | 17.2 | 3.1 | 15.5 |
| 1.2ep-8 | 1 | 11.8 | 12.6 | 2.4 | 47.7 | 17.1 | 3.6 | 17.3 |
| | 2 | 12.1 | 12.9 | 2.5 | 47.0 | 16.9 | 3.7 | 17.9 |
| | 3 | 12.7 | 12.8 | 2.9 | 45.9 | 16.9 | 3.7 | 18.0 |
| | Avg | 12.2 | 12.8 | 2.6 | 46.9 | 17.0 | 3.7 | 17.8 |
| 1.9ep-63 | 1 | 12.5 | 12.9 | 2.7 | 46.1 | 17.5 | 3.3 | 15.9 |
| | 2 | 12.6 | 12.7 | 2.8 | 46.2 | 17.3 | 3.3 | 16.0 |
| | 3 | 13.0 | 12.6 | 3.2 | 45.7 | 16.9 | 3.4 | 16.8 |
| | Avg | 12.7 | 12.7 | 2.9 | 46.0 | 17.2 | 3.3 | 16.3 |
| 1.4ep-161 | 1 | 13.7 | 12.3 | 3.5 | 45.8 | 16.2 | 3.3 | 17.0 |
| | 2 | 12.4 | 12.7 | 2.9 | 46.9 | 16.8 | 3.2 | 16.0 |
| | 3 | 12.5 | 12.4 | 3.0 | 46.8 | 16.9 | 3.3 | 16.3 |
| | Avg | 12.9 | 12.5 | 3.1 | 46.5 | 16.6 | 3.3 | 16.4 |

TABLE 22

Confirmation Assay #2: Lipid Composition In Transformant Y. lipolytica Strain Y2224, Expressing EgD9eS Or ePCR Library Mutant Variants Thereof

| Strain | Replicate No. | 16:0 | 16:1 | % TFAs 18:0 | 18:1 | LA | EDA | % Conv LA to EDA |
|---|---|---|---|---|---|---|---|---|
| EgD9eS Control-2 | 1 | 12.0 | 12.1 | 3.0 | 50.2 | 14.0 | 2.9 | 16.9 |
|  | 2 | 12.0 | 11.6 | 3.1 | 50.4 | 14.0 | 2.7 | 16.0 |
|  | 3 | 11.8 | 12.1 | 3.0 | 51.1 | 14.4 | 2.8 | 16.3 |
| EgD9eS Control-5 | 1 | 11.8 | 12.1 | 3.2 | 50.6 | 13.7 | 3.2 | 18.9 |
|  | 2 | 11.9 | 12.2 | 3.2 | 51.0 | 13.9 | 3.3 | 19.2 |
|  | 3 | 11.8 | 11.8 | 3.2 | 51.8 | 13.9 | 2.9 | 17.1 |
| EgD9eS Control-6 | 1 | 11.8 | 11.7 | 3.2 | 51.1 | 14.0 | 2.8 | 16.6 |
|  | 2 | 11.8 | 11.9 | 3.3 | 51.0 | 14.5 | 2.8 | 16.4 |
|  | 3 | 11.6 | 12.2 | 2.8 | 51.3 | 14.9 | 2.8 | 15.8 |
| EgD9eS Control-7 | 1 | 11.9 | 11.8 | 3.4 | 51.1 | 14.3 | 2.8 | 16.2 |
|  | 2 | 11.8 | 12.0 | 3.2 | 51.1 | 14.2 | 2.8 | 16.6 |
|  | 3 | 12.0 | 12.0 | 3.2 | 50.8 | 14.1 | 2.8 | 16.5 |
| Avg. Control | — | 11.9 | 11.9 | 3.2 | 51.0 | 14.1 | 2.9 | 16.9 |
| 2.1ep-94 | 1 | 11.7 | 11.1 | 2.8 | 50.0 | 14.9 | 3.5 | 19.2 |
|  | 2 | 10.8 | 11.8 | 2.0 | 50.5 | 15.8 | 3.9 | 19.9 |
|  | 3 | 11.1 | 11.5 | 2.0 | 51.2 | 15.3 | 3.9 | 20.2 |
|  | Avg | 11.2 | 11.5 | 2.3 | 50.5 | 15.3 | 3.8 | 19.8 |
| 2.1ep-95 | 1 | 11.8 | 10.9 | 2.7 | 50.4 | 15.1 | 3.5 | 18.9 |
|  | 2 | 11.8 | 11.0 | 2.6 | 50.6 | 15.5 | 3.5 | 18.6 |
|  | 3 | 12.0 | 11.0 | 3.2 | 50.1 | 15.1 | 3.5 | 18.7 |
|  | Avg | 11.9 | 11.0 | 2.8 | 50.4 | 15.2 | 3.5 | 18.8 |

In summarizing the data shown above in confirmation assay #1, clones of Y. lipolytica strain Y2224 that were transformed with pZuFmEgD9ES, comprising the non-mutant codon-optimized EgD9eS gene, produced an average of 3.1 EDA % TFAs, wherein the average conversion efficiency ["% Conv"] of LA to EDA in these five clones was determined to be about 15.5%. In contrast, the average % Conv of LA to EDA for mutant strain 1.2ep-8 was 17.8% (or 115% relative to the control); the average % Conv for mutant strain 1.9ep-63 was 16.3% (or 105% relative to the control); and, the average % Conv for mutant strain 1.4ep-161 was 16.4% (or 106% relative to the control).

In confirmation assay #2, clones of Y. lipolytica strain Y2224 that were transformed with pZuFmEgD9ES produced 2.9 EDA % TFAs, wherein the average % Conv of LA to EDA in these four strains was determined to be about 16.9%. The average % Conv of LA to EDA for mutant strain 2.1ep-94 was 19.8% (or 117% relative to the control); and, the average % Conv for mutant strain 2.1 ep-95 was 18.8% (or 111% relative to the control).

Thus, these experiments confirmed the improved delta-9 elongase conversion efficiency exhibited by EgD9eS ePCR mutants 1.2ep-8, 1.9ep-63, 1.4ep-161, 2.1ep-94 and 2.1ep-95.

Sequence of EgD9eS ePCR Mutants

The plasmids rescued from mutants 1.2ep-8, 1.9ep-63, 1.4ep-161, 2.1ep-94 and 2.1ep-95 were characterized by DNA sequencing, and analysis revealed various nucleotide substitutions and expressed amino acid substitutions within the mutant EgD9eS genes, as shown in Table 23. A designation indicative of the amino acid substitution was given to each mutant EgD9eS gene and to each mutant pZuFmEgD9ES plasmid comprising the mutant EgD9eS gene. For each substitution listed (i.e. L35G), the first letter corresponds to the amino acid in the non-mutant EgD9eS (i.e., SEQ ID NO:3) and the second letter corresponds to the amino acid found in the same position in the mutant, i.e. L35G indicates a change from Leu in EgD9eS at position 35 to Gly in the EgD9eS mutant).

TABLE 23

Summary of Sequenced EgD9eS ePCR Library Mutants

| ePCR Mutant | Nucleotide Substitution | Resulting Amino Acid Substitution (Silent Mutation) | Designation For Mutant Gene | Designation For Mutant Plasmid |
|---|---|---|---|---|
| 1.2ep-8 | C103T and A654G | L35F and (G218G) | "EgD9eS-L35F" (SEQ ID NO: 118) | pZuFmEgD9ES-L35F (SEQ ID NO: 120) |
| 1.9ep-63 | A173G, T234G, G402A and T770C | K58R, (S78S), (Q134Q) and I257T | "EgD9eS-K58R/I257T" (SEQ ID NO: 121) | pZuFmEgD9eS-K58R/I257T (SEQ ID NO: 123) |
| 1.4ep-161 | C388A, C450T and T728C | L130M, (N150N) and V243A | "EgD9eS-L130M/V243A$_1$" (SEQ ID NO: 124) | pZuFmEgD9ES-L130M/V243A$_1$ (SEQ ID NO: 126) |
| 2.1ep-95 | A293G | D98G | "EgD9eS-D98G" (SEQ ID NO: 127) | pZuFmEgD9ES-D98G (SEQ ID NO: 129) |
| 2.1ep-94 | C21T, C388A, C450T and T728C | (I71), L130M, (N150N) and V243A | "EgD9eS-L130M/V243A$_2$" (SEQ ID NO: 130) | pZuFmEgD9ES-L130M/V243A$_2$ (SEQ ID NO: 132) |

Thus, for example, the plasmid rescued from mutant 1.2ep-8 comprised 2 nucleotide substitutions (i.e., C103T and A654G). These two nucleotide substitutions correspond to one expressed amino acid substitution (i.e., L35F), and one silent amino acid mutation (i.e., G218G; since both GGA and GGG code for Gly, this amino acid was unchanged in the mutant protein as a result of the A654G nucleotide substitution). The plasmid comprising the C103T and A654G mutations, resulting in the amino acid change L35F, was designated as pZuFmEgD9ES-L35F (SEQ ID NO:120), while the nucleotide sequence of the mutant delta-9 elongase therein is designated as "EgD9eS-L35F" (SEQ ID NO:118), having a protein sequence as set forth in SEQ ID NO:119.

Example 10E

Construction of a Two-Site-Saturation EgD9eS Gene Library

The present example describes the synthesis of a site-saturation ["SS"] library, prepared by targeting amino acid positions 35 and 107 within EgD9eS (SEQ ID NO:3). The rationale for targeting position 35 was based on the results of Example 10D, while the rationale for targeting position 107 is described below. The SS library was created in a two-step method that first required the generation of megaprimers comprising targeted mutations within the template, followed by use of these megaprimers to make point mutations into pZuFmEgD9ES.

Rationale for Targeting Position 107 of EgD9eS

First, the amino acid sequences of 17 fatty acid elongases, as described in Table 24 below, were aligned using the ClustalW method of alignment.

TABLE 24

Fatty Acid Elongases Subjected To Conservation Pattern Analysis

| Elongase Abbreviation | Organism | Reference | SEQ ID NO |
|---|---|---|---|
| Ci_elo | *Ciona intestinalis* | GenBank Accession No. AAV67802 | 133 |
| Om_elo | *Oncorhynchus mykiss* | GenBank Accession No. AAV67803 | 134 |
| Mp_elo1 | *Marchantia polymorpha* | GenBank Accession No. AAT85662 | 135 |
| Pp_elo1 | *Physcomitrella patens* | GenBank Accession No. AAL84174 | 136 |
| Mp_d5e | *Marchantia polymorpha* | GenBank Accession No. BAE71130 | 137 |
| Ot_elo1 | *Ostreococcus tauri* | GenBank Accession No. AAV67797 | 138 |
| Pav_elo2 | *Pavlova* sp. CCMP459 | GenBank Accession No. AAV33630 | 139 |
| Ps_elo2 | *Pavlova salina* | GenBank Accession No. AAY15135 | 140 |
| Ot_elo2 | *Ostreococcus tauri* | GenBank Accession No. AAV67798 | 141 |
| Ea_d9e | *Euglena anabaena* | U.S. Pat. No. 7,794,701 | 34 |
| Eg_d9e | *Euglena gracilis* | U.S. Pat. No. 7,645,604 | 32 |
| E398_d9e | *Eutreptiella* sp. CCMP389 | U.S. Pat. No. 7,645,604 | 38 |
| Ig_d9e | *Isochrysis galbana* | PCT Publications No. WO 2002/077213, No. WO 2005/083093, No. WO 2005/012316 and No. WO 2004/057001; GenBank Accession No. AAL37626 | 42 |
| Tp_elo2 | *Thalassiosira pseudonana* | GenBank Accession No. AAV67800 | 142 |
| Tp_elo1 | *Thalassiosira pseudonana* | GenBank Accession No. AAV67799 | 143 |
| Ma_d6e | *Mortierella alpina* | GenBank Accession No. AAF70417 | 144 |
| Th_elo2 | *Thraustochytrium* sp. FJN-10 | GenBank Accession No. ABC18314 | 145 |

Figure 15B:
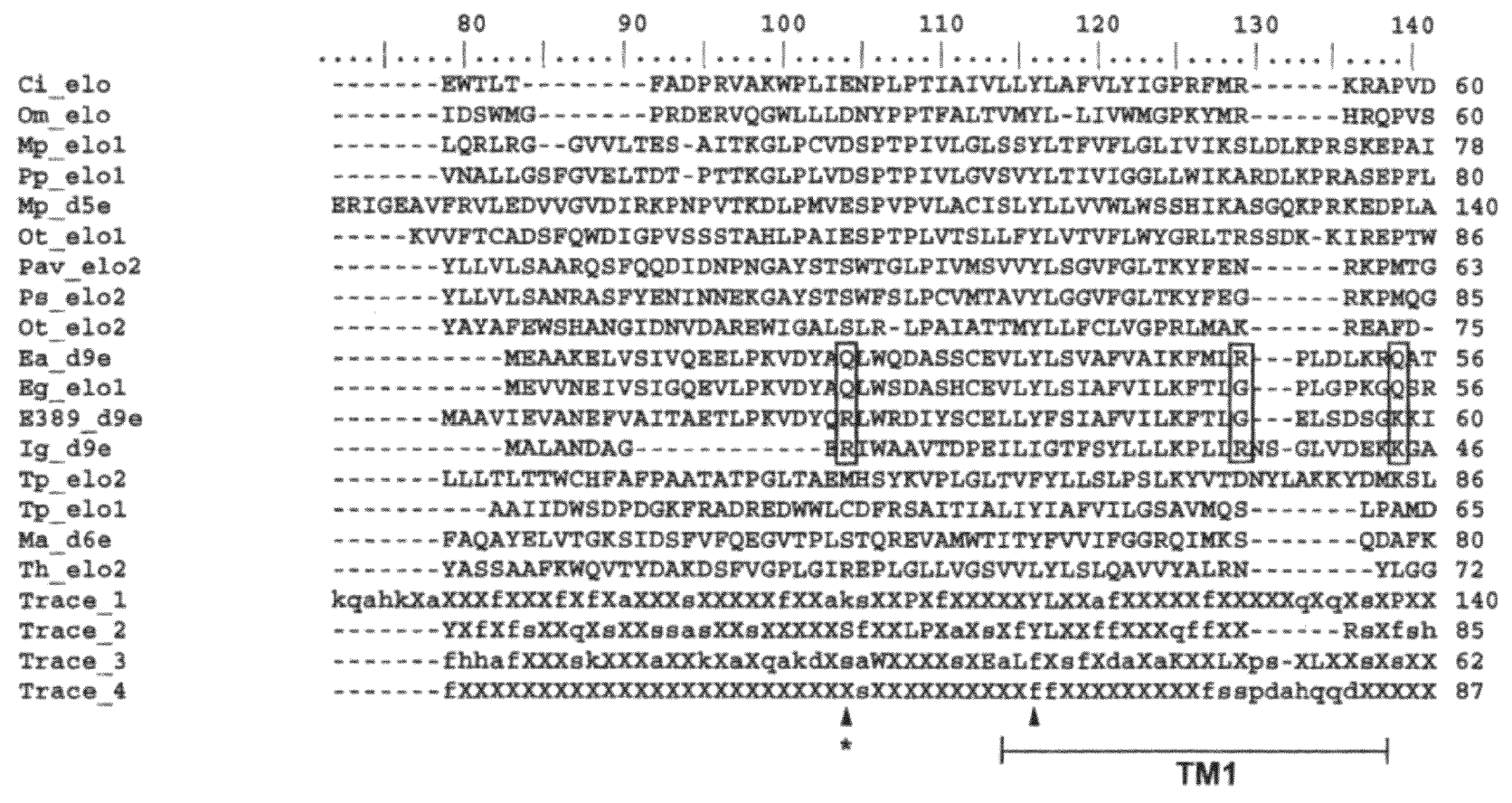
Figure 15C:
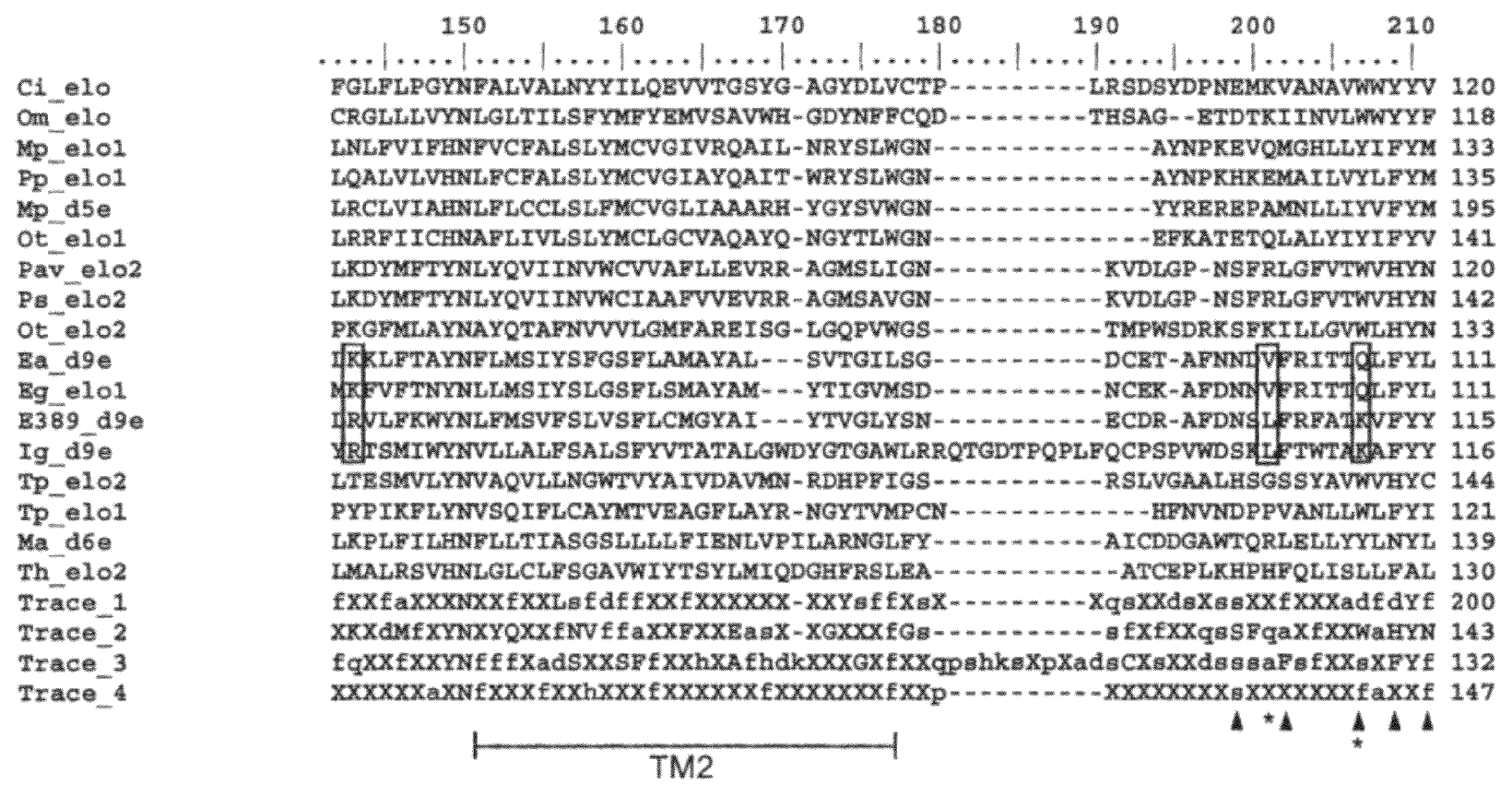
Figure 15D:
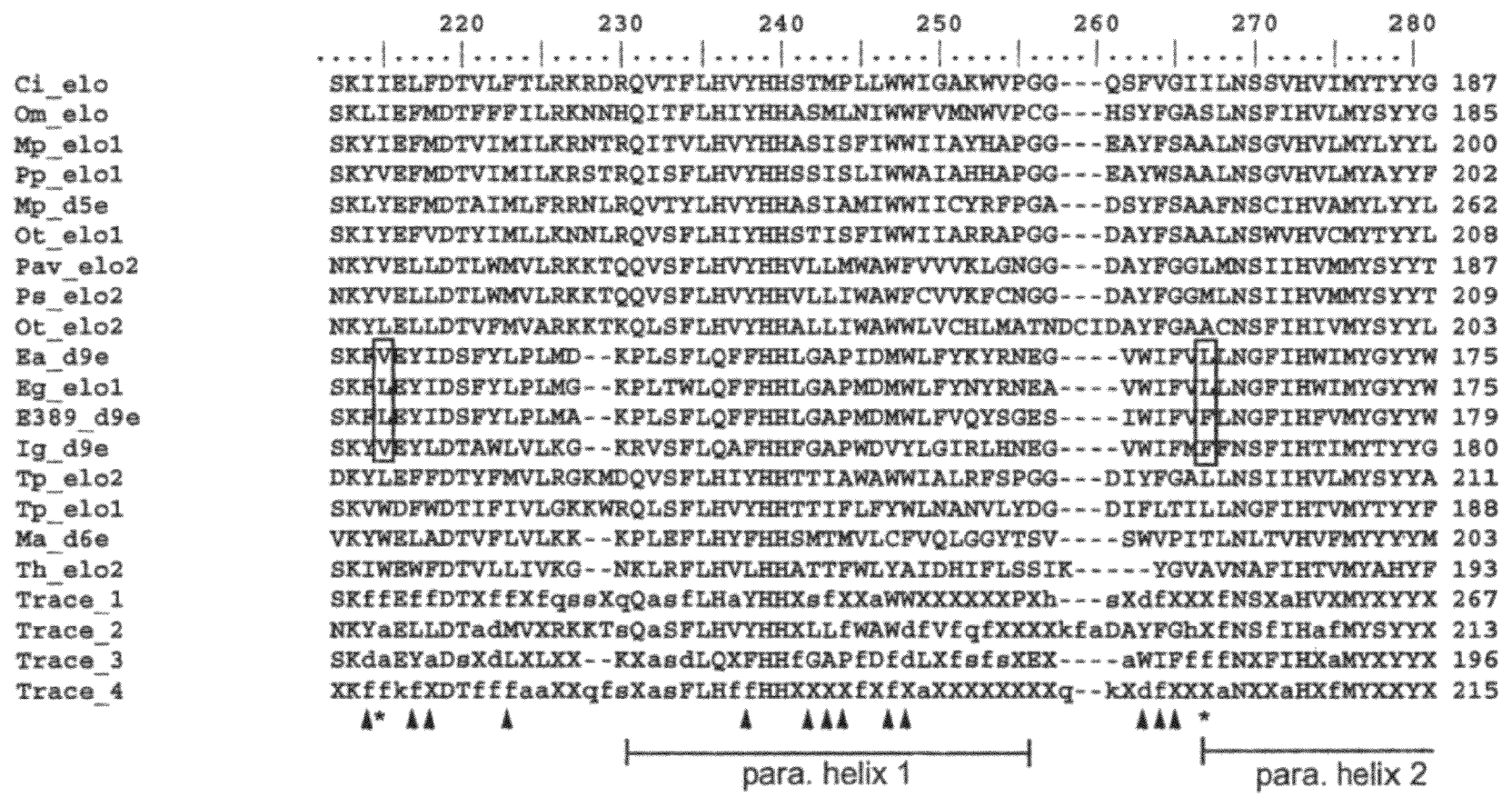

The Clustal W alignment method, described by Thompson et al. (*Nucleic Acids Res.* 22:4673-4680 (1994)), was performed using a ClustalW package (Version 1.83) with default parameters (i.e., protein weight matrix=Gonnet 250, gap opening penalty=10, gap extension penalty=0.2 and full alignment algorithm). Results of the alignment are shown in FIG. 15 (comprising FIGS. 15A, 15B, 15C, 15D, 15E, 15F, 15G and 15H). "Trace_1", "Trace_2", "Trace_3" and "Trace_4" represent the consensus of each column for functional Group I, Group II, Group III and Group IV, as defined infra, i.e., Trace 1 represents the consensus of the protein sequences in Group I, comprising Ci_elo, Om_elo, Mp_elo1, Pp_elo1, Mp_d5e and Ot_elo1. The consensus of each column was defined as follows. Specifically, if the column was completely conserved, then the consensus was represented as the conserved amino acid, shown as a capital letter. If the column was conserved in terms of physio-chemical properties, then the consensus was represented with a lower case letter, wherein "k" represents amino acids D and E (negatively-charged), "q" represents amino acids H, K and R (positively-charged), "p" represents amino acids N and Q (polar), "a" represents amino acids I, L and V (aliphatic), "d" represents amino acids F, W and Y (aromatic), "h" represents amino acids A and G (tiny), "s" represents amino acids D, E, N, Q, H, K, R, S and T (hydrophilic) and "f" represents amino acids I, L, V, F, W, Y, C and M (hydrophobic). If the column was not conserved, then the consensus was represented with a capital letter "X".

A neighbor-joining tree was generated from the Clustal W alignment. Based on the tree topology, the 17 sequences were partitioned into 4 groups, which are hypothesized to correspond to functional groups of different substrate specificity: Group I comprises Ci_elo, Om_elo, Mp_elo1, Pp_elo1, Mp_d5e and Ot_elo1; Group II comprises Pav_elo2, Ps_elo2 and Ot_elo2; Group III comprises Ea_d9e, Eg_d9e, E398_d9e and Ig_d9e; and, Group IV comprises Tp_elo2, Tp_elo1, Ma_d6e and Th_elo2.

Considering the alignment of FIG. 15 and the groupings of the neighbor-joining tree, the following conclusions were drawn. First, some positions are absolutely conserved across all 17 sequences within Group I, II, III and IV. These positions were considered to likely be essential for the catalytic activity of the elongase, and thus were eliminated as targets for mutation. Some positions were conserved in only some of the sequences within Group I, II, III and IV (i.e., not absolutely conserved). These positions were considered to likely be important for the substrate specificity exhibited by elongases within the functional groups of Group I, II, III or IV. Some positions were relatively conserved within Group III (comprising all four of the known delta-9 elongases), but variations were also exhibited; see, amino acid positions 22, 47, 54, 101, 107, 111, 115, 161, 182, 192 and 242, based on numbering of EgD9e. These positions were considered to likely be important for the activity of delta-9 elongases, and were hypothesized to modulate the differences in substrate specificity of Ea_d9e (SEQ ID NO:34), Eg_d9e (SEQ ID NO:32), E398_d9e (SEQ ID NO:38) and Ig_d9e (SEQ ID NO:42).

An analysis of the transmembrane ["TM"] domains within EgD9eS was performed using the TMHMM program ("Prediction of transmembrane helices in proteins"; TMHMM Server v. 2.0, Center for Biological Sequence Analysis, Bio-Centrum-DTU, Technical University of Denmark, DK-2800 Lyngby, Denmark). The prediction indicated six membrane-spanning helices (corresponding to amino acid residues 32-51, 66-88, 114-136, 156-175, 188-206, 221-243), with both N- and C-termini located on the cytoplasmic side. When Ot_elo2, Ig_elo1, Pav_elo2 and Tp_elo2 were similarly analyzed using the TMHMM program, the number of membrane-spanning helices varied from 4 to 8. Thus, in order to consolidate these varying predictions, the following pieces of functional information were used.

1. The highly conserved histidine-rich motif [Q/H]xxHH ("His-box"), has been shown to be essential for optimum enzyme activity of Ig_d9e (SEQ ID NO:42), but is not directly responsible for substrate specificity (Qi et al., *FEBS Letters*, 547:137-139 (2003)). Thus, it strongly suggests that the His-box (corresponding to amino acid residues 134-138 in EgD9eS) is involved in the active site; and, it should be located in or near the cytosolic side of the folded protein such that substrate can access the active site.

2. Several highly conserved positions with charged residues are present at the C-terminal end of EgD9eS. They are likely relevant for the activity and thus the C-terminus is probably located in the cytosolic side of the folded protein.

In contrast to the TMHMM results which predicted a membrane-spanning helix between amino acid residues 114-136 and between amino acid residues 156-175, the above considerations indicate that the sequence region between residues 114-136 does not span the membrane since the His-box cannot be located in the external face of the membrane. If the C-terminus is located in the cytosolic side, then the predicted TM domain between 156-175 also does not span the membrane. Because the substrate for the elongase is highly hydrophobic, it will likely partition into the lipid bilayer. The active site (including the His-box) may occur at or very near the membrane surface.

Therefore, it is predicted herein that these two hydrophobic regions (i.e., corresponding to amino acid residues 114-136 and amino acid residues 156-175) lie in or near the inner membrane leaflet to ensure the active site sits close to the membrane. The final membrane topology model predicted for EgD9eS is shown in FIG. 16A. Specifically, each vertical cylinder indicates a membrane-spanning segment, while each horizontal cylinder indicates a hydrophobic stretch that lies in or near the inner membrane leaflet. The conserved Gln [Q] and His [H] residues within the His-box (i.e., corresponding to amino acid residues 134-138) are indicated with small circles. Finally, "in" corresponds with the cytoplasmic space, while "out" corresponds with the periplasmic space.

While conservation pattern analysis identified 11 different amino acid residues within the Group III delta-9 fatty acid elongases (i.e., Ea_d9e [SEQ ID NO:34], Eg_d9e [SEQ ID NO:32], E398_d9e [SEQ ID NO:38] and Ig_d9e [SEQ ID NO:42]) that were predicted to affect enzyme activity, the results from the predicted topology model further limited candidate residues. Specifically, it was reasoned that positions that were important for enzymatic activity had to be on or near the cytosolic side, where the active site lies. Amino acid residues 47, 54 and 192 failed to meet this criterion and thus it was assumed that they could not be important for modulating the activity of the delta-9 elongases.

Based on the above rationale, the candidate residues that were likely to significantly impact delta-9 elongase activity of EgD9eS were reduced from 258 residues within the full-length protein of SEQ ID NO:3 to only 8 residues, corresponding to positions 22, 101, 107, 111, 115, 161, 182 and 242. These eight positions were recommended as targets for site-directed mutagenesis to improve the substrate conversion rate of EgD9eS. The experimental data below targeted position 107.

Creation of Megaprimers for Construction of the Site-Saturation Library

Oligonucleotides EgD9E_102_053008f (SEQ ID NO:146) and EgD9E_760_053008r (SEQ ID NO:147) were designed to target amino acid residues 35 and 107, respectively, of EgD9eS (SEQ ID NO:3). Following commercial synthesis of these oligonucleotides, they were utilized in a PCR reaction to create suitable megaprimers for use in the construction of the SS library. Specifically, a 50 µl reaction mixture was prepared to contain: 5.0 µl of 10× reaction buffer supplied with Pfu-Ultra polymerase (Stratagene), 1.0 µl of 50 ng/µl EgD9eS (SEQ ID NO:2), 1.0 µl of 10 pmol/µl primer EgD9E_102_053008f (SEQ ID NO:146), 1.0 µl of 10 pmol/µl primer EgD9E_760_053008r (SEQ ID NO:147), 1.0 µl of 40 mM dNTP mix (Promega, Madison, Wis.), 1.0 µl high fidelity Pfu-Ultra DNA polymerase (Stratagene) and 40 µl water. The mixture was placed in a thin well 200 µl tube for the PCR reaction in Mastercycler gradient equipment (Brinkmann Instruments, Inc. Westbury, N.Y.). PCR amplification was performed using the following conditions: 95° C. for 30 sec, followed by 30 cycles of denaturation at 95° C. for 30 sec, annealing at 54° C. for 1 min, and elongation at 72° C. for 2 min. A final elongation cycle at 72° C. for 4 min was carried out, followed by reaction termination at 4° C.

The PCR products were purified using a DNA Clean & Concentrator™-5 kit (Cat. No. D4003, Zymo Research, Orange, Calif.), as recommended by the manufacturer. The purified double-stranded PCR products were utilized as "megaprimers", each containing various mutations within EgD9eS.

Site-Directed Mutagenesis to Create Site-Saturation Mutant Genes of EgD9eS

The "megaprimers" described above were then utilized in reactions designed to introduce the EgD9eS mutations within the "megaprimers" into pZuFmEgD9ES (FIG. 14; SEQ ID NO:115), thereby replacing the non-mutant EgD9eS gene with various mutant EgD9eS genes. This was accomplished using the QuikChange® II XL site directed mutagenesis kit (Cat. No. 200524, Stratagene, La Jolla, Calif.), as described in Example 10C. Specifically, the composition of the site directed mutagenesis reaction and amplification conditions were identical to that described in Example 10C, as was the method of DpnI restriction and DNA clean-up.

Example 10F

Identification of EgD9eS Site-Saturation Library Mutants Having Improved Delta-9 Elongase Conversion Efficiency The present Example describes: 1) the identification of EgD9eS mutants having improved delta-9 elongase conversion efficiency of LA to EDA, as compared to that of the wildtype protein EgD9eS (SEQ ID NO:3); and, 2) sequence analysis of these EgD9eS mutants.

Identification of EgD9eS Site-Saturation Mutants

The SS library prepared in Example 10E was transformed into *E. coli* Top 10 electro-competent cells, purified and subsequently transformed into *Y. lipolytica* strain Y2224, as described in Example 10B. The fatty acid profiles of 510 *Yarrowia* transformants with constructs from the SS library were analyzed using the quick screen "plate assay" of Example 10B. Three transformants were confirmed to exhibit improved delta-9 elongation activity as compared to the control, based on the confirmation assay of Example 10B.

Data from the confirmation assay is presented in Table 25, and the FAME profiles of individual pZuFmEgD9ES control transformants are compared with those of SS library mutants. More specifically, the concentration of each fatty acid as an area percent of TFAs ["% TFAs"] and % Conv. of LA to EDA (determined as described in Example 10B) for each strain is shown below in Table 25, while averages are highlighted in gray and indicated with "Avg". Fatty acids are identified based on the abbreviations of Example 10D.

Sequence of EgD9eS Site-Saturation Mutants

The plasmids rescued from mutants 2.4sd-24, 2.4sd-52 and 2.4sd-53 were characterized by DNA sequencing, and analysis revealed various nucleotide substitutions and expressed amino acid substitutions within the mutant EgD9eS genes, as shown in Table 26. A designation indicative of the amino acid substitution was given to each mutant EgD9eS gene and to each mutant pZuFmEgD9ES plasmid comprising the mutant EgD9eS gene.

TABLE 26

Summary of Sequenced EgD9eS SS Library Mutants

| Site-Saturation Mutant | Nucleotide Substitution | Resulting Amino Acid Substitution | Designation For Mutant Gene | Designation For Mutant Plasmid |
|---|---|---|---|---|
| 2.4sd-24 | C103G, T104G, C105G | L35G | "EgD9eS-L35G" (SEQ ID NO: 43) | pZuFmEgD9ES-L35G (SEQ ID NO: |

TABLE 25

Confirmation Assay: Lipid Composition In Transformant *Y. lipolytica* Strain Y2224, Expressing EgD9eS Or SS Library Mutant Variants Thereof

| Strain | Replicate No. | % TFAs | | | | | | % Conv LA to EDA |
|---|---|---|---|---|---|---|---|---|
| | | 16:0 | 16:1 | 18:0 | 18:1 | LA | EDA | |
| EgD9eS Control-1 | 1 | 12.6 | 11.5 | 5.2 | 47.0 | 15.0 | 3.4 | 18.3 |
| | 2 | 12.5 | 11.8 | 4.9 | 47.1 | 15.1 | 3.4 | 18.4 |
| EgD9eS Control-2 | 1 | 12.7 | 11.5 | 4.2 | 48.5 | 15.4 | 3.4 | 18.0 |
| | 2 | 12.0 | 12.0 | 4.1 | 47.1 | 16.9 | 3.8 | 18.2 |
| | 3 | 12.9 | 11.3 | 4.4 | 48.3 | 15.4 | 3.4 | 18.0 |
| EgD9eS Control-3 | 1 | 12.5 | 11.7 | 3.7 | 49.4 | 15.5 | 3.5 | 18.6 |
| | 2 | 12.4 | 11.6 | 5.1 | 47.8 | 15.0 | 3.4 | 18.6 |
| | 3 | 12.1 | 11.8 | 5.0 | 48.3 | 15.4 | 3.5 | 18.6 |
| EgD9eS Control-4 | 1 | 12.3 | 11.5 | 5.2 | 47.7 | 15.0 | 3.7 | 19.8 |
| | 2 | 12.4 | 11.8 | 4.7 | 48.1 | 15.0 | 3.5 | 19.1 |
| | 3 | 12.7 | 11.7 | 3.8 | 48.7 | 15.1 | 3.7 | 19.8 |
| Avg. Control | — | 12.5 | 11.6 | 4.6 | 48.0 | 15.3 | 3.5 | 18.7 |
| 2.4sd-24 | 1 | 12.6 | 11.8 | 4.0 | 48.6 | 13.3 | 4.9 | 27.0 |
| | 2 | 12.6 | 11.6 | 4.6 | 48.6 | 13.0 | 4.9 | 27.5 |
| | 3 | 12.5 | 11.8 | 3.9 | 49.6 | 13.2 | 4.9 | 27.0 |
| Avg | | 12.6 | 11.7 | 4.1 | 48.9 | 13.2 | 4.9 | 27.2 |
| 2.4sd-52 | 1 | 12.6 | 11.5 | 3.8 | 50.3 | 13.2 | 4.7 | 26.4 |
| | 2 | 12.5 | 11.2 | 4.3 | 49.4 | 13.2 | 4.7 | 26.2 |
| | 3 | 12.6 | 11.2 | 5.0 | 48.7 | 12.8 | 4.8 | 27.2 |
| Avg | | 12.6 | 11.3 | 4.4 | 49.4 | 13.1 | 4.7 | 26.6 |
| 2.4sd-53 | 1 | 12.6 | 12.0 | 3.6 | 50.1 | 13.8 | 4.5 | 24.8 |
| | 2 | 12.3 | 12.0 | 3.8 | 49.1 | 14.4 | 4.6 | 24.3 |
| | 3 | 12.5 | 12.4 | 3.6 | 49.2 | 13.6 | 4.4 | 24.6 |
| Avg | | 12.5 | 12.1 | 3.7 | 49.5 | 13.9 | 4.5 | 24.6 |

In the confirmation assay, clones of *Y. lipolytica* strain Y2224 that were transformed with pZuFmEgD9ES, comprising the non-mutant codon-optimized EgD9eS gene, produced an average of 3.5 EDA % TFAs, wherein the average conversion efficiency ["% Conv"] of LA to EDA in these four strains was determined to be about 18.7%. By comparison, the average % Conv of LA to EDA for mutant strain 2.4sd2-24 was 27.2% (or 145% relative to the control); the average % Conv for mutant strain 2.4sd2-52 was 26.6% (or 142% relative to the control); and, the average % Conv for mutant strain 2.4sd2-53 was 24.6% (or 132% relative to the control). This assay therefore confirmed the improved delta-9 elongase conversion efficiency exhibited by site-saturation mutants 2.4sd2-24, 2.4sd2-52 and 22.4sd2-53.

TABLE 26-continued

Summary of Sequenced EgD9eS SS Library Mutants

| Site-Saturation Mutant | Nucleotide Substitution | Resulting Amino Acid Substitution | Designation For Mutant Gene | Designation For Mutant Plasmid |
|---|---|---|---|---|
| 2.4sd-52 | C103G, T104G, C105G | L35G | | 148) |
| 2.4sd-53 | C103A, C105G, C319G | L35M and Q107E | "EgD9eS-L35M/Q107E" (SEQ ID NO: 149) | pZuFmEgD9ES-L35M/Q107E (SEQ ID NO: 151) |

As will be obvious to one of skill in the art, the Applicants appreciate that a variety of nucleotide sequences can encode, e.g., the protein set forth as EgD9eS-L35G, based on the degeneracy of the genetic code. Thus, for example, the Gly encoded in the mutant protein set forth as SEQ ID NO:44 at amino acid residue position 35 can be encoded by GGG (as in the delta-9 elongase open reading frame ["ORF"] set forth in SEQ ID NO:43), GGA (as in the delta-9 elongase ORF set forth in SEQ ID NO:152), GGC (as in the delta-9 elongase ORF set forth in SEQ ID NO:153) and GGT (as in the delta-9 elongase ORF set forth in SEQ ID NO:154). A variety of other nucleotide substitutions that result in silent mutations in the encoded protein are also contemplated, and thus the nucleotide sequences provided herein which encode EgD9eS-L35G (SEQ ID NO:44) should not be construed as a limitation to the present disclosure. Similar variation is contemplated within any of the nucleotide sequences described herein, encoding the mutant proteins of the invention and having delta-9 elongase activity.

Example 10G

Creation of EgD9eS-L35G SlonoMax® Libraries

The present example describes the synthesis of SlonoMax® libraries, prepared by targeting 50 distinct amino acid positions within the EgD9eS-L35G mutant (SEQ ID NO:44; Example 10F), which demonstrated a 42-45% improvement in LA to EDA conversion efficiency when compared to the parent enzyme. Thus, this Example sought to identify additional beneficial mutations that could be "stacked" into the EgD9eS mutant comprising the L35 mutation.

Slonomics®, an automated robotic platform described in additional detail infa, generates SlonoMax® libraries where the number of mutants per sequence position and their ratios can be very precisely controlled. Thus, the automated process offers advantages in that the number of candidate residues that could be experimentally examined to determine their impact on delta-9 elongase activity could be greatly increased, as opposed to the limited residues considered upon creation of the site-saturation library (Example 10E).

Rationale for Targeting 50 Distinct Residues within EgD9eS For Functional Site Evaluation Delta-9 elongases have been identified and functionally characterized from *Isochrysis galbana* ["IgD9e"] (SEQ ID NO:42; PCT Publications No. WO 2002/077213, No. WO 2005/083093, No. WO 2005/012316 and No. WO 2004/057001; GenBank Accession No. AAL37626), *Eutreptiella* sp. CCMP389 ["E389D9e"] (SEQ ID NO:38; U.S. Pat. No. 7,645,604), *Euglena gracilis* ["EgD9e"] (SEQ ID NO:32; U.S. Pat. No. 7,645,604) and *E. anabaena* ["EaD9e"] (SEQ ID NO:34; U.S. Pat. No. 7,794,701). Each of these elongases has been shown to be capable of converting LA to EDA. EgD9e, EaD9e and E389D9e share more than 60% sequence similarity with one another, while IgD9E shares only about 35% sequence similarity to any one of EgD9e, EaD9e, and E389D9e (based on ClustalW (Version 1.83) analyses, using default parameters (i.e., protein weight matrix=Gonnet 250, gap opening penalty=10, gap extension penalty=0.2 and full alignment algorithm).

It was observed that positions leading to mutants with improved delta-9 elongase conversion efficiency (e.g., D98G [Example 10D] and L35G [Example 10F]) have moderate sequence conservativeness. An amino acid sequence alignment of IgD9e, EgD9e, EaD9e and E389D9e was created to identify other moderately conserved residues, using default parameters of Vector NTI®'s AlignX program (Invitrogen Corporation, Carlsbad, Calif.) (FIG. 17). The delta-9 elongase motifs of U.S. Pat. No. 7,645,604, conserved among all of the aligned sequences, are shown in the Figure as underlined, bolded text within the consensus sequence. Bolded residues within the EgD9e sequence of SEQ ID NO:32 (which is identical in sequence to that of EgD9eS, as set forth in SEQ ID NO:3) indicate residues that were mutated to result in a mutant elongase having improved delta-9 elongase activity. The locations of these mutations are also highlighted with an asterisk over each row of the alignment.

It was hypothesized that these moderately conserved residues might be good candidates as targets for amino acid substitution to potentially yield a second generation of mutant enzymes having improved activity relative to the non-mutant EgD9eS control.

Comparing the sequence of these four homologous enzymes, 58 of the 258 amino acid positions were determined to be conserved among all four elongase enzymes; thus, these residues were eliminated from consideration. Additionally, 92 positions were determined to be conserved between EgD9e, EaD9e and E389D9e; these positions were also eliminated from consideration. Lastly, since positions having random amino acid changes among homologs normally do not play a significant role in protein function, an additional 22 positions determined to possess four different amino acid residues among all four elongase enzymes were thus eliminated from consideration as targeted positions for functional evaluation.

The remaining 86 positions within SEQ ID NO:32 (i.e., positions 1, 3, 4, 5, 9, 12, 21, 22, 27, 28, 29, 32, 35, 37, 41, 42, 45, 47, 48, 51, 52, 53, 54, 57, 58, 60, 62, 63, 66, 67, 70, 71, 73, 74, 80, 83, 84, 85, 89, 94, 98, 101, 104, 105, 107, 108, 111, 115, 127, 131, 132, 143, 149, 152, 153, 155, 156, 161, 168, 169, 179, 181, 182, 192, 196, 204, 207, 209, 210, 211, 216, 218, 222, 223, 225, 229, 236, 239, 242, 244, 245, 247, 250, 254, 257 and 258) were considered as potential targets for functional site evaluation. A comparison of the amino acid residue that is encoded at each one of these positions in EgD9e (SEQ ID NO:32), EaD9e (SEQ ID NO:34) and E389E9e (SEQ ID NO:38) is shown below in Table 27.

TABLE 27

Positions For Functional Site Evaluation

| Position* | EgD9e | EaD9e | 389D9e |
|---|---|---|---|
| 1 | M | M | I |
| 3 | V | A | V |
| 4 | V | A | A |
| 5 | N | K | N |
| 9 | S | S | A |
| 12 | Q | Q | A |
| 21 | A | A | Q |
| 22 | Q | Q | R |
| 27 | A | A | I |
| 28 | S | S | Y |
| 29 | H | S | S |
| 32 | V | V | L |
| 35 | L | L | F |
| 37 | I | V | I |
| 41 | I | A | I |
| 42 | L | I | L |
| 45 | T | M | T |
| 47 | G | R | G |
| 48 | P | P | E |
| 51 | P | L | D |

TABLE 27-continued

| Position | | | |
|---|---|---|---|
| 52 | K | K | S |
| 53 | G | R | G |
| 54 | Q | Q | K |
| 57 | M | L | L |
| 58 | K | K | R |
| 60 | V | L | L |
| 62 | T | T | K |
| 63 | N | A | W |
| 66 | L | F | L |
| 67 | L | L | F |
| 70 | I | I | V |
| 71 | Y | Y | F |
| 73 | L | F | L |
| 74 | G | G | V |
| 80 | A | A | G |
| 83 | M | L | I |
| 84 | Y | S | Y |
| 85 | T | V | T |
| 89 | M | L | Y |
| 94 | E | E | D |
| 98 | D | N | D |
| 101 | V | V | L |
| 104 | I | I | F |
| 105 | T | T | A |
| 107 | Q | Q | K |
| 108 | L | L | V |
| 111 | L | L | Y |
| 115 | L | V | L |
| 127 | G | D | A |
| 131 | T | S | S |
| 132 | W | F | F |
| 143 | M | I | M |
| 149 | Y | Y | V |
| 152 | R | R | S |
| 153 | N | N | G |
| 155 | A | G | S |
| 156 | V | V | I |
| 161 | L | L | F |
| 168 | W | W | F |
| 169 | I | I | V |
| 179 | I | I | M |
| 181 | L | L | F |
| 182 | K | N | N |
| 192 | S | S | A |
| 196 | I | I | T |
| 204 | I | I | L |
| 207 | K | K | W |
| 209 | R | R | K |
| 210 | N | N | D |
| 211 | I | V | I |
| 216 | Q | Q | K |
| 218 | G | G | P |
| 222 | F | F | L |
| 223 | G | A | A |
| 225 | F | I | I |
| 229 | F | W | W |
| 236 | C | L | L |
| 239 | L | L | I |
| 242 | Y | Y | F |
| 244 | Q | Q | K |
| 245 | T | T | S |
| 247 | I | I | V |
| 250 | K | P | K |
| 254 | A | R | A |
| 257 | I | K | K |
| 258 | Q | E | V |

*Position is based on alignment against EgD9e (SEQ ID NO: 32), which has an identical sequence to that of EgD9eS (SEQ ID NO: 3).

Of the 86 positions identified above in Table 27, those sites having greatest proximity to the periplasmic space, based on the membrane topology model of FIG. 16A, were eliminated from further consideration (i.e., positions 45, 47, 48, 51, 52, 53, 54, 57, 58, 60, 62, 63, 66, 67, 70, 71, 73, 74, 204, 207, 209, 210, 211, 216, 218, 222, 223, 225 and 229). Those sites highlighted in gray with bold text (i.e., positions 3, 5, 9, 12, 21, 22, 27, 28, 32, 37, 41, 42, 80, 84, 85, 94, 98, 101, 104, 105, 107, 108, 111, 115, 127, 131, 132, 143, 149, 152, 153, 156, 161, 168, 169, 179, 181, 182, 192, 196, 236, 239, 242, 244, 245, 247, 250, 254, 257 and 258 of EgD9eS) were selected for further experimental evaluation.

Slonomics® to Create SlonoMax® Mutant Genes of EgD9eS-L35G

Slonomics® (U.S. Pat. No. 7,695,906) uses a set of double stranded DNA triplets as universal building blocks for the synthesis of combinatorial libraries "one codon at a time" (Sloning BioTechnology, Puchheim, Germany). For library production, multiple codons can be introduced in parallel at any desired sequence position. The absence of functional bias and the ability to select and precisely control delivery of up to 20 codons at any ratio results in exceptionally high quality libraries containing the complete set of desired mutants.

SlonoMax® gene libraries (50 total) were thus created by Sloning BioTechnology, each gene library possessing at least 16 independent and unique sequence mutations at the targeted position (i.e., position 3, 5, 9, 12, 21, 22, 27, 28, 32, 37, 41, 42, 80, 84, 85, 94, 98, 101, 104, 105, 107, 108, 111, 115, 127, 131, 132, 143, 149, 152, 153, 156, 161, 168, 169, 179, 181, 182, 192, 196, 236, 239, 242, 244, 245, 247, 250, 254, 257 or 258 of EgD9eS), using pZuFmEgD9ES-L35G (SEQ ID NO:148) as the template.

All EgD9eS-L35G mutants were cloned into the vector backbone provided by pZuFmEgD9ES-L35G and subsequently transformed into *Y. lipolytica* strain Y2224 and cultured, as described in Example 10B. The transformed cells (provided as frozen glycerol stocks) and DNA were obtained from Sloning BioTechnology. A small portion of transformed cells and DNA were sequenced and confirmed.

Example 10H

Identification of EgD9eS-L35G SlonoMax® Library Mutants Having Improved Delta-9 Elongase Conversion Efficiency The present Example describes the identification of EgD9eS-L35G SlonoMax® mutants having improved delta-9 elongase conversion efficiency of LA to EDA, as compared to that of the variant protein EgD9eS-L35G identified in Example 10F (SEQ ID NO:44).

The fatty acid profiles of 807 *Yarrowia* transformants with constructs from the SlonoMax® library were screened using the "confirmation assay" methodology of Example 10B, such that cells grown on fresh re-streaked MM plates were used to individually inoculate triplicate cultures comprising 3 mL liquid MM. In addition to the 807 mutants, *Yarrowia* strain Y2224 transformants, comprising pZuFmEgD9ES-L35G (SEQ ID NO:148) were inoculated in triplicate as experimental controls.

Data from selected mutants in the confirmation assay is presented in Table 28, and the FAME profiles of three representative EgD9eS-L35G controls are compared with those of the SlonoMax® library mutants demonstrating an increase in average % Conv. of LA to EDA. More specifically, the average (indicated with "Avg") concentration of each fatty acid as an area percent of TFAs ["% TFAs"] and the average % Conv. of LA to EDA (determined as described in Example 10B) for each strain is shown below in Table 28. Fatty acids are identified based on the abbreviations of Example 10D. Each strain description is indicative of the particular amino acid substitutions present in the respectively mutant EgD9eS gene. Thus, strain EgD9eS-L35G/S9A comprises a mutant pZuFmEgD9ES plasmid comprising a mutant EgD9eS gene, the gene having a L35G mutation and a S9A mutation when compared to the sequence of EgD9eS set forth as SEQ ID NO:3.

basis for comparison of mutants from the EgD9eS site-evaluation library presented in Table 28.

Among the 26 selected elongase variants presented in Table 28, eleven were identified (highlighted in bold text) as demonstrating comparable or improved significantly delta-9 elongase conversion activity relative to the control data of Table 28. These mutants included EgD9eS-L35G/S9D (141% increase), EgD9eS-L35G/A21V (118% increase), EgD9eS-L35G/V32F (104% increase), EgD9eS-L35G/Y84C (144% increase), EgD9eS-L35G/L108G (104%

TABLE 28

Confirmation Assay: Lipid Composition In Transformant *Y. lipolytica* Strain Y2224, Expressing EgD9eS-L35G Or SlonoMax ® Mutant Variants Thereof

| Strain | Replicate No. | % TFAs 16:0 | 16:1 | 18:0 | 18:1 | 18:2 | 20:2 | % Conv LA to EDA |
|---|---|---|---|---|---|---|---|---|
| EgD9eS-L35G | 1 | 13.7 | 12.0 | 2.9 | 40.4 | 19.0 | 4.8 | 20.2 |
| Control-1 | 2 | 14.2 | 12.7 | 2.9 | 41.7 | 19.5 | 4.4 | 18.5 |
|  | 3 | 13.8 | 12.2 | 3.0 | 41.1 | 19.1 | 4.9 | 20.4 |
| EgD9eS-L35G | 1 | 13.8 | 12.5 | 2.8 | 40.7 | 19.8 | 4.5 | 18.4 |
| Control-2 | 2 | 14.0 | 12.5 | 2.8 | 41.1 | 19.8 | 3.7 | 15.6 |
|  | 3 | 13.8 | 12.3 | 2.9 | 41.0 | 19.7 | 4.5 | 18.6 |
| EgD9eS-L35G | 1 | 13.9 | 12.8 | 2.7 | 41.7 | 18.5 | 3.9 | 17.5 |
| Control-3 | 2 | 13.7 | 12.7 | 2.7 | 42.6 | 19.0 | 3.7 | 16.2 |
|  | 3 | 14.1 | 12.9 | 2.8 | 41.7 | 19.1 | 4.1 | 17.5 |
| Avg. Control | — | 13.9 | 12.5 | 2.8 | 41.3 | 19.3 | 4.3 | 18.1 |
| EgD9eS-L35G/S9A | Avg of 3 | 12.3 | 12.8 | 3.1 | 49.9 | 12.9 | 3.8 | 22.8 |
| EgD9eS-L35G/S9D | Avg of 3 | 12.3 | 12.3 | 3.2 | 48.6 | 12.2 | 4.3 | 25.6 |
| EgD9eS-L35G/S9G | Avg of 3 | 12.6 | 12.7 | 3.1 | 51.1 | 12.2 | 3.8 | 23.3 |
| EgD9eS-L35G/S9I | Avg of 3 | 13.0 | 12.2 | 2.9 | 52.5 | 12.2 | 3.1 | 20.4 |
| EgD9eS-L35G/S9K | Avg of 3 | 12.4 | 12.4 | 2.9 | 52.3 | 12.1 | 3.5 | 22.1 |
| EgD9eS-L35G/S9Q | Avg of 3 | 12.5 | 13.1 | 2.8 | 52.0 | 12.4 | 3.1 | 20.1 |
| EgD9eS-L35G/Q12K | Avg of 3 | 12.5 | 14.1 | 2.6 | 51.4 | 11.6 | 3.3 | 22.3 |
| EgD9eS-L35G/A21D | Avg of 3 | 12.4 | 14.2 | 2.7 | 49.7 | 12.1 | 3.3 | 21.4 |
| EgD9eS-L35G/A21T | Avg of 3 | 12.3 | 13.3 | 2.9 | 50.3 | 13.2 | 3.3 | 20.0 |
| EgD9eS-L35G/A21V | Avg of 3 | 12.7 | 15.1 | 2.3 | 49.1 | 13.4 | 3.6 | 21.3 |
| EgD9eS-L35G/V32F | Avg of 3 | 12.2 | 14.9 | 2.4 | 49.4 | 14.0 | 3.2 | 18.8 |
| EgD9eS-L35G/Y84C | Avg of 3 | 11.9 | 13.3 | 2.6 | 51.5 | 12.8 | 4.5 | 26.1 |
| EgD9eS-L35G/L108G | Avg of 3 | 13.0 | 13.4 | 3.0 | 48.4 | 14.8 | 3.4 | 18.8 |
| EgD9eS-L35G/G127L | Avg of 3 | 9.7 | 11.0 | 1.9 | 36.6 | 24.5 | 5.7 | 18.8 |
| EgD9eS-L35G/W132T | Avg of 3 | 13.8 | 12.8 | 3.0 | 43.7 | 18.2 | 4.0 | 18.1 |
| EgD9eS-L35G/M143N | Avg of 3 | 10.1 | 11.1 | 2.0 | 39.6 | 21.4 | 4.5 | 17.4 |
| EgD9eS-L35G/M143W | Avg of 3 | 11.4 | 12.2 | 2.3 | 43.8 | 18.4 | 4.4 | 19.1 |
| EgD9eS-L35G/L161T | Avg of 3 | 11.1 | 12.1 | 2.7 | 41.3 | 17.8 | 5.6 | 23.7 |
| EgD9eS-L35G/L161Y | Avg of 3 | 9.9 | 11.8 | 2.6 | 37.4 | 22.3 | 6.1 | 21.5 |
| EgD9eS-L35G/W168G | Avg of 3 | 11.5 | 12.3 | 2.5 | 44.0 | 17.6 | 4.7 | 20.8 |
| EgD9eS-L35G/I79M | Avg of 3 | 13.8 | 12.5 | 3.0 | 41.5 | 18.5 | 4.3 | 18.8 |
| EgD9eS-L35G/I179R | Avg of 3 | 10.2 | 11.9 | 2.2 | 40.5 | 18.4 | 6.3 | 25.5 |
| EgD9eS-L35G/C236N | Avg of 3 | 13.3 | 13.4 | 2.8 | 45.5 | 16.9 | 3.8 | 18.5 |
| EgD9eS-L35G/Q244N | Avg of 3 | 10.2 | 12.4 | 2.2 | 38.2 | 17.9 | 5.7 | 24.2 |
| EgD9eS-L35G/A254W | Avg of 3 | 11.7 | 16.8 | 2.0 | 48.8 | 14.8 | 3.7 | 20.2 |
| EgD9eS-L35G/A254Y | Avg of 3 | 13.1 | 16.2 | 2.5 | 48.4 | 12.9 | 3.4 | 21.0 |

It is noteworthy that the fatty acid profile and the % Conv. of LA to EDA of the replicate EgD9eS-L35G controls presented in Table 28 are somewhat different from the EgD9eS-L35G profiles previously presented. In the present set of experiments, the EgD9eS-L35G control "underperformed" in comparison to previous analyses (i.e., the average % Conv. of LA to EDA was determined to be about 18.1%, supra, while the average % Conv. of LA to EDA was determined to be about 26.6% and 27.2% in Example 10F, Table 25). However, the transformants with EgD9eS-L35G produced 4.3 EDA % TFAs (average, supra), which was significantly greater than that produced in transformants with EgD9eS (i.e., 3.1 EDA % TFAs [Example 10D, Table 21], 2.9 EDA % TFAs [Example 10D, Table 22], and 3.5 EDA % TFAs [Example 10F, Table 25]). For this reason, performance from previous experiments that repeated the functional analysis of EgD9eS-L35G (data not shown) was used in addition to EgD9eS-L35G performance in the present experiment as the increase), EgD9eS-L35G/W132T (100% increase), EgD9eS-L35G/M143N (96% increase), EgD9eS-L35G/L161T (131% increase), EgD9eS-L35G/I179R (141% increase), EgD9eS-L35G/C236N (102% increase) and EgD9eS-L35G/Q244N (134% increase), wherein the delta-9 elongase conversion activity with respect to EgD9eS is shown in parantheses. Thus, up to a 44% improvement in LA to EDA conversion efficiency was demonstrated.

Example 10I

Creation of a EgD9eS-L35G/S9D/A21V/V32F/ Y84C/L108G/W132T/M143N/L161T/I179R/ C236N/Q244N Combinatorial Library The present example describes the synthesis of a mutant EgD9eS combinatorial library, wherein various combinations of the beneficial mutations identified above in Example 10H (i.e., L35G, S9D, A21V, V32F, Y84C, L108G, W132T, M143N, L161T, I179R, C236N and Q244N) were "stacked" together into the EgD9eS mutant comprising the L35 mutation.

Creation of Synthetic Primers for Construction of the Combinatorial Library

Eleven pairs of primers were commercially synthesized, as described in SEQ ID NOs:155-176 (see Table 29, infra). Each primer pair was designed to introduce one of the following mutations into the EgD9eS-L35G gene: S9D, A21V, V32F, Y84C, L108G, W132T, M143N, L161T, I179R, C236N and Q244N.

The primers were phosphorylated at 37° C. for 60 min using T4 polynucleotide kinase ["PNK"] (Cat. No. 70031Z, USB Corp.) and then deactivated at 65° C. for 20 min. Each 20 μl phosphorylation reaction mixture contained: 2.0 μl of 10×T4 PNK buffer, 15.0 μl of primer DNA (about 7 μM), 0.6 μl of 100 mM ATP, 0.4 μl of T4 PNK and 2.0 μl of water.

Multiple Mutation Site Mutagenesis to Create Combinatorial Mutant Genes of EgD9eS-L35G The Change-IT™ Multiple Mutation Site Directed Mutagenesis Kit (Cat. No. 78480, USB Corporation, Cleveland, Ohio) was used to introduce the S9D, A21V, V32F, Y84C, L108G, W132T, M143N, L161T, I179R, C236N and Q244N mutations into EgD9eS-L35G in a series of 6 reactions, each reaction (with the exception of the final reaction) introducing two new mutations based on inclusion of a forward primer and reverse primer of Primer Set "A" and a forward primer and reverse primer of Primer Set "B" (Table 29). While the initial template in the series of reactions was EgD9eS-L35G, the product of Change-IT™ Rxn. 1 served as the template in Change-IT™ Rxn. 2, etc.

More specifically, two 25 μl PCR reaction mixtures were prepared, each one comprising 2.5 μl of 10× Change-IT™ buffer, 2.5 μl of phosphorylated forward primer, 2.5 μl of phosphorylated reverse primer, 1.0 μl of template (50 ng/μl), 15.5 μl Nuclease-free water and 1.0 μl Change-IT™ Fideli-Taq enzyme. The first reaction utilized primers from primer set "A", while the second utilized primer set "B" primers. PCR amplification was performed using the following conditions: 95° C. for 2 min, followed by 30 cycles of denaturation at 95° C. for 30 sec, annealing at 55° C. for 30 sec, and elongation/ligation at 68° C. for 25 min. A final elongation/ligation cycle at 68° C. for 30 min was carried out, followed by the reaction termination at 4° C.

Following amplification, the template was removed by adding DpnI enzyme and digestion was performed at 37° C. for 3 hr. The PCR DNA was used to transform *E. coli* Top 10 electro-competent cells (Cat. No. C404052, Invitrogen, Carlsbad, Calif.) by electroporation. The transformed cells were spread onto LB with 100 mg/L ampicillin agar plates and grown in a 37° C. incubator overnight. Plasmid DNA was extracted from the transformant *E. coli* cells using a QIAprep® Spin Miniprep kit (Qiagen Inc., Valencia, Calif.) following the manufacturer's protocol. The purified DNA was then used as template in the next Change-IT™ reaction. Following the sixth reaction, which introduced the last of the 11 mutations into the original EgD9eS-L35G template, DNA was purified from the transformant *E. coli* cells, as described above. The DNA was then transformed into *Y. lipolytica* strain Y2224 (supra, Example 10B).

Example 10J

Identification of EgD9eS-L35G/S9D/A21V/V32F/Y84C/L108G/W132T/M143N/L161T/I179R/C236N/Q244N Combinatorial Library Mutants Having Improved Delta-9 Elongase Conversion Efficiency The present Example describes: 1) the identification of EgD9eS-L35G/S9D/A21V/V32F/Y84C/L108G/W132T/M143N/L161T/I179R/C236N/Q244N combinatorial library mutants having improved delta-9 elongase conversion efficiency of LA to EDA, as compared to that of the wildtype protein EgD9eS (SEQ ID NO:3); 2) sequence analysis of these EgD9eS mutants; and, 3) re-creation of the sequenced EgD9eS mutants to confirm the improved delta-9 elongase conversion efficiency.

Identification of EgD9eS-L35G/S9D/A21V/V32F/Y84C/L108G/W132T/M143N/L161T/I179R/C236N/Q244N Combinatorial Library Mutants

TABLE 29

Summary Of Change-IT ™ Multiple Mutation Site Directed Mutagenesis Reactions

| Change-IT ™ Rxn. No. | Template | Product | Primer Set "A" | | Primer Set "B" | |
|---|---|---|---|---|---|---|
| | | | Forward Primer | Reverse Primer | Forward Primer | Reverse Primer |
| #1 | EgD9eS-L35G | Change-IT ™ Rxn. #1 | Eg_9D_122709f (SEQ ID NO: 155) | Eg_84C_122709r (SEQ ID NO: 156) | Eg_84C_122709f (SEQ ID NO: 157) | Eg_9D_122709r (SEQ ID NO: 158) |
| #2 | Change-IT ™ Rxn. #1 | Change-IT ™ Rxn. #2 | Eg_161T_122709f (SEQ ID NO: 159) | Eg_179R_122709r (SEQ ID NO: 160) | Eg_179R_122709f (SEQ ID NO: 161) | Eg_161T_122709r (SEQ ID NO: 162) |
| #3 | Change-IT ™ Rxn. #2 | Change-IT ™ Rxn. #3 | Eg_244N_122709f (SEQ ID NO: 163) | Eg_21V_010710r (SEQ ID NO: 164) | Eg_21V_010710f (SEQ ID NO: 165) | Eg_244N_122709r (SEQ ID NO: 166) |
| #4 | Change-IT ™ Rxn. #3 | Change-IT ™ Rxn. #4 | Eg_32F_010710f (SEQ ID NO: 167) | Eg_108G_010710r (SEQ ID NO: 168) | Eg_108G_010710f (SEQ ID NO: 169) | Eg_32F_010710r (SEQ ID NO: 170) |
| #5 | Change-IT ™ Rxn. #4 | Change-IT ™ Rxn. #5 | Eg_132T_010710f (SEQ ID NO: 171) | Eg_143N_010710r (SEQ ID NO: 172) | Eg_143N_010710f (SEQ ID NO: 173) | Eg_132T_010710r (SEQ ID NO: 174) |
| #6 | Change-IT ™ Rxn. #5 | Change-IT ™ Rxn. #6 | Eg_236N_010710f (SEQ ID NO: 175) | Eg_236N_010710r (SEQ ID NO: 176) | — | — |

The fatty acid profiles of 2,388 *Yarrowia* transformants with constructs from the combinatorial library (Example 10I) were screened using the quick screen "plate assay" of Example 10B. Most of these mutants exhibited reduced conversion of LA to EDA compared to the wild type control, EgD9eS (SEQ ID NO:3). However, five transformants were confirmed to exhibit improved delta-9 elongation activity as compared to the control, based on confirmation assays of Example 10B.

The DNA sequences of the mutant EgD9eS genes were determined using colony PCR. In brief, a small quantity of yeast cells was sampled from freshly streaked plates using a sterile pipette tip and the cells were suspended in 20 µl of molecular grade water. Cell suspension (2 µl) was transferred to TaKaRa Ex Taq PCR mix prepared according to the manufacturer's recommendation (Takara Biotechnology Co., LTD.). The primers used for colony PCR were forward primer FBAIN-F (SEQ ID NO:366) and reverse primer Y1026 (SEQ ID NO:367). The thermal cycler program included an initial denaturation of template at 94° C. for 5 min, followed by 40 cycles of denaturation at 94° C. for 30 sec, annealing at 56° C. for 30 sec and extension at 72° C. for 3 min. A final extension at 72° C. for 6 min was carried out.

The PCR products were sequenced with primers FBAIN-F (SEQ ID NO:366) and Y1026 (SEQ ID NO:367). Analysis of the DNA sequence data revealed the nucleotide substitutions and expressed amino acid substitutions within the mutant EgD9eS genes. A designation indicative of the amino acid substitution was given to the mutant EgD9eS gene and to the mutant pZuFmEgD9ES plasmid comprising the mutant EgD9eS gene, as shown in Table 30.

TABLE 30

Summary of Sequenced EgD9eS Combinatorial Library Mutants

| Combinatorial Mutant | Nucleotide Substitution | Resulting Amino Acid Substitution | Designation For Mutant Gene | Designation For Mutant Plasmid |
|---|---|---|---|---|
| EgD9EN-427 | C103G, T104G, and C105G | L35G | EgD9eS-L35G/W132T/I179R (SEQ ID NO: 368) | pZuFmEgD9ES-L35G/W132T/I179R (SEQ ID NO: 370) |
|  | T394A, G395C, G396C | W132T |  |  |
|  | A535C, T536G, C537A | I179R |  |  |
| EgD9EN-1043 | T25G, C26A | S9D | EgD9eS-S9D/L35G/Y84C/I179R (SEQ ID NO: 371) | pZuFmEgD9ES-S9D/L35G/Y84C/I179R (SEQ ID NO: 373) |
|  | C103G, T104G, and C105G | L35G |  |  |
|  | A251G, C252T | Y84C |  |  |
|  | A535C, T536G, C537A | I179R |  |  |
| EgD9EN-1534 | C62T and T63G | A21V | EgD9eS-A21V/L35G/L108G/I179R (SEQ ID NO: 177) | pZuFmEgD9ES-A21V/L35G/L108G/I179R (SEQ ID NO: 179) |
|  | C103G, T104G and C105G | L35G |  |  |
|  | C322G, T323G and G324T | L108G |  |  |
|  | A535C, T536G and C537A | I179R |  |  |
| EgD9EN-1635 | C103G, T104G, and C105G | L35G | EgD9eS-L35G/Y84C/I179R/Q244N (SEQ ID NO: 374) | pZuFmEgD9ES-L35G/Y84C/I179R/Q244N (SEQ ID NO: 376) |
|  | A251G, C252T | Y84C |  |  |
|  | A535C, T536G, C537A | I179R |  |  |
|  | C730A, G732C | Q244N |  |  |
| EgD9EN-1734 | C62T, T63G | A21V | EgD9eS-A21V/L35G/W132T/I179R/Q244N (SEQ ID NO: 377) | pZuFmEgD9ES-A21V/L35G/W132T/I179R/Q244N (SEQ ID NO: 379) |
|  | C103G, T104G, and C105G | L35G |  |  |
|  | T394A, G395C, G396C | W132T |  |  |
|  | A535C, T536G, C537A | I179R |  |  |
|  | C730A, G732C | Q244N |  |  |

New primers for site-directed mutagenesis were designed, based on the amino acid substitutions of Table 30. These primers were then utilized in reactions designed to introduce the EgD9eS mutations within the "megaprimers" into pZuFmEgD9ES (FIG. 2; SEQ ID NO:115), thereby replacing the non-mutant EgD9eS gene with the various mutant EgD9eS genes identified in Table 30. This was accomplished using the QuikChange® II XL site directed mutagenesis kit (Cat. No. 200524, Stratagene, La Jolla, Calif.), as described in Example 10C. These mutant genes were transformed into *E. coli* Top 10 electro-competent cells, purified, sequenced, and subsequently transformed into *Y. lipolytica* strain Y2224, as described in Example 10B. In this way, the mutant EgD9eS genes shown in Table 30 were recreated on plasmids and re-introduced back into strain Y2224 to confirm that the improved delta-9 elongase conversion efficiency exhibited by the EgD9eS combinatorial mutants was attributed to the identified amino acid substitutions.

Data from these confirmation assays are presented in Table 31, and the FAME profiles of individual pZuFmEgD9ES control transformants are compared with those mutants of the combinatorial library. For a conservative comparison, the data shown for each strain represents the FAME profiles for the 3 isolates with highest % Conv. of LA to EDA for each strain. More specifically, the concentration of each fatty acid as an area percent of TFAs ["% TFAs"] and % Conv. of LA to EDA (determined as described in Example 10B) for each strain is shown below, while averages are highlighted in gray and indicated with "Avg". Fatty acids are identified based on the abbreviations of Example 10D.

and 11M, sets forth experimental data to support the description of a mutant polypeptide having delta-5 desaturase activity comprising: (a) an amino acid motif as set forth in SEQ ID NO:180 [HxGx], wherein SEQ ID NO:180 [HxGx] is not identical to SEQ ID NO:181 [HPGG]; and, (b) an amino acid motif as set forth in SEQ ID NO:182 [HxxxH], wherein SEQ ID NO:182 [HxxxH] is not identical to SEQ ID NO:183 [HDASH].

TABLE 31

Confirmation Assay: Lipid Composition In Transformant
*Y. lipolytica* Strain Y2224, Expressing EgD9eS Or Combinatorial Mutant Variants Thereof

| Strain | Replicate No. | 16:0 | 16:1 | % TFAs 18:0 | 18:1 | 18:2 | 20:2 | % Conv LA to EDA |
|---|---|---|---|---|---|---|---|---|
| EgD9eS- Control | 1 | 12.5 | 12.6 | 2.8 | 50.6 | 13.1 | 2.6 | 16.7 |
| | 2 | 12.1 | 13.1 | 2.5 | 52.1 | 13.4 | 2.5 | 15.8 |
| | 3 | 12.5 | 13.1 | 2.8 | 51.0 | 13.3 | 2.5 | 15.8 |
| | Avg | 12.4 | 12.9 | 2.7 | 51.2 | 13.2 | 2.5 | 16.1 |
| EgD9EN-427 | 1 | 11.6 | 13.2 | 2.6 | 49.7 | 14.2 | 3.2 | 18.1 |
| | 2 | 12.2 | 12.7 | 2.6 | 51.5 | 13.0 | 2.9 | 18.0 |
| | 3 | 11.8 | 12.7 | 2.5 | 52.4 | 13.0 | 2.7 | 17.2 |
| | Avg | 11.9 | 12.9 | 2.6 | 51.2 | 13.4 | 2.9 | 17.8 |
| EgD9eN-1043 | 1 | 11.7 | 13.3 | 2.4 | 52.2 | 13.3 | 2.8 | 17.7 |
| | 2 | 11.8 | 12.8 | 2.5 | 51.9 | 12.8 | 2.8 | 17.9 |
| | 3 | 11.8 | 12.6 | 2.5 | 51.6 | 12.8 | 2.6 | 16.9 |
| | Avg | 11.8 | 12.9 | 2.4 | 51.9 | 13.0 | 2.8 | 17.5 |
| EgD9EN-1534 | 1 | 11.4 | 11.8 | 2.4 | 48.4 | 12.5 | 2.6 | 17.2 |
| | 2 | 12.0 | 12.4 | 2.5 | 49.8 | 13.3 | 2.6 | 16.6 |
| | 3 | 12.2 | 12.4 | 2.6 | 50.8 | 13.1 | 2.6 | 16.6 |
| | Avg | 11.9 | 12.2 | 2.5 | 49.7 | 13.0 | 2.6 | 16.8 |
| EgD9eN-1635 | 1 | 11.1 | 12.9 | 2.4 | 51.2 | 13.1 | 3.0 | 18.8 |
| | 2 | 11.5 | 13.8 | 2.5 | 49.4 | 14.1 | 3.1 | 18.1 |
| | 3 | 11.9 | 13.5 | 2.6 | 50.1 | 14.1 | 2.9 | 17.1 |
| | Avg | 11.5 | 13.4 | 2.5 | 50.2 | 13.8 | 3.0 | 18.0 |
| EgD9EN-1734 | 1 | 11.5 | 12.7 | 2.4 | 51.7 | 12.4 | 3.3 | 21.1 |
| | 2 | 11.3 | 12.5 | 2.2 | 51.3 | 12.1 | 3.2 | 20.7 |
| | 3 | 11.8 | 12.8 | 2.4 | 52.8 | 13.0 | 2.6 | 18.0 |
| | Avg | 11.5 | 12.7 | 2.3 | 51.9 | 12.5 | 3.1 | 20.0 |

Clones of *Y. lipolytica* strain Y2224 that were transformed with pZuFmEgD9ES, comprising the codon-optimized EgD9eS gene of SEQ ID NO:2 (non-mutant), produced an average of 2.5 EDA % TFAs, wherein the average conversion efficiency ["% Conv"] of LA to EDA in these three clones was determined to be about 16.1%. In contrast, the average % Conv of LA to EDA for mutant strain EgD9EN-427 was 17.8% (or 110% relative to the control). Similarly, the average % Conv of LA to EDA for mutant strain EgD9EN-1043 was 17.5% (or 108% relative to the control). The average % Conv of LA to EDA for mutant strain EgD9EN-1534 was 16.8% (or 104% relative to the control); the average % Conv for mutant strain EgD9EN-1635 was 18.0% (or 111% relative to the control); and, the average % Conv for mutant strain EgD9EN-1734 was 20.0% (or 123% relative to the control).

Thus, these experiments thereby confirmed the improved delta-9 elongase conversion efficiency exhibited by EgD9eS combinatorial library mutants EgD9EN-427, EgD9EN-1043, EgD9EN-1534, EgD9EN-1635, and EgD9EN-1734, wherein the improvement ranged from 4-23%.

Example 11

Mutant HPGG (SEQ ID NO:181) Motif And HDASH (SEQ ID NO:183) Motif Delta-5 Desaturases The present Example, set forth in parts herein as Examples 11A, 11B, 11C, 11D, 11E, 11F, 11G, 11H, 11I, 11J, 11K, 11L More specifically, the following is a description of a mutant polypeptide having delta-5 desaturase activity and having an amino acid sequence selected from the group consisting of: SEQ ID NO:110 [EgD5S-36s157g or EgD5S-HPGs_HDgSH]; SEQ ID NO:112 [EaD5S-35a158g or EaD5S-HaGG_HDgSH]; SEQ ID NO:106 [EgD5R*-34g158g or EgD5R*-HgGG_HDAgH]; and, SEQ ID NO:108 [EgD5R*-34g158g347s or EgD5R*-HgGG_HDAgH_347s].

Examples 11A, 11C, 11D, 11E, 11F, 11G, 11H, 11I, 11J, 11K, 11L and 11M are also set forth in U.S. Provisional Patent Application No. 61/428,277 [filed Dec. 30, 2010], incorporated herein by reference in its entirety.

*Y. lipolytica* strain Y4036U (Leu−, Ura−), described in Inn App. Pub. No. WO 2008/073367, was used as the host in Examples 11D, 11E, 11F, 11H, 11I and 11K, infra.

Strain Y4036U was derived from *Y. lipolytica* ATCC #20362 via construction of strain Y2224 (Ura3−, a FOA resistant mutant from an autonomous mutation of the Ura3 gene), strain Y4001 (producing 17% EDA with a Leu− phenotype), strain Y4001U1 (Leu− and Ura−) and strain Y4036 (producing 18% DGLA with a Leu− phenotype).

The final genotype of strain Y4036U with respect to wild type *Y. lipolytica* ATCC #20362 was Ura3−, YAT1::ME3S::Pex16, EXP1::EgD9eS::Lip1, FBAINm::EgD9eS::Lip2, GPAT::EgD9e::Lip2, FBAINm::EgD8M::Pex20, EXP1::EgD8M::Pex16, GPD::FmD12::Pex20, YAT1::FmD12::OCT.

Example 11A

Development of a Topological Model for the *Euglena gracilis* Delta-5 Desaturase ["EgD5"]

In order to better predict the possible importance of the HDASH motif within the delta-5 desaturase from *E. gracilis* ["EgD5"; U.S. Pat. No. 7,678,560; SEQ ID NOs:184 and 185], a topological model (FIG. 18) was developed based on the logic and analyses below.

First, an analysis of transmembrane domains of EgD5 was performed using the TMHMM program ("Prediction of transmembrane helices in proteins"; TMHMM Server v. 2.0, Center for Biological Sequence Analysis, BioCentrum-DTU, Technical University of Denmark, DK-2800 Lyngby, Denmark). The prediction indicated six membrane-spanning helices (amino acid residues 103-125, 130-152, 165-187, 234-256, 280-302 and 306-328), with both the N- and C-termini located on the cytoplasmic side of the membrane.

A similar TMHMM analysis was performed using the following homologs of EgD5: GenBank Accession No. AAT09160 [*Nitzchia closterium* f. *minutissima*], GenBank Accession No. BAG71007 [*Oblongichytrium* sp. SEK 347], and GenBank Accession No. AAL92562 [*Phaeodactylum tricornutum*]. For each homolog, four transmembrane segments were predicted, which corresponded to the first two and the last two transmembrane domains predicted for EgD5.

The membrane-bound fatty acid desaturases belong to a superfamily of membrane di-iron proteins that feature three histidine-rich (His-rich) motifs: $HX_{(3-4)}H$ (SEQ ID NOs:186 and 187), $HX_{(2-3)}HH$ (SEQ ID NOs:188 and 189) and (H/Q)$X_{(2-3)}HH$ (SEQ ID NOs:190 and 191). These His-rich residues have been predicted to be located in the cytoplasmic face of the membrane and have been shown to be important for enzyme activity (Shanklin, J. et al., *Biochemistry*, 33:12787-12794 (1994); Shanklin, J., and Cahoon, E. B., *Annu. Rev. Plant Physiol. Plant Mol. Biol.*, 49:611-641 (1998)). Within EgD5, the first His-rich region (HDASH [SEQ ID NO:183]) is located before the third predicted transmembrane segment spanning amino acid residues 165-187, while the second His-rich region (HIMRHH [SEQ ID NO:189]) is located after this transmembrane segment. If the third transmembrane segment indeed spans the membrane, then the second His-rich region would be located in the periplasmic space—thus preventing its participation in the iron-active site. As a result, it was hypothesized that neither the third transmembrane segment (amino acid residues 165-187) nor the fourth transmembrane segment (amino acid residues 234-256) were membrane spanning. This was consistent with the TMHMM predictions for the three delta-5 desaturase homologs (i.e., GenBank Accession No. AAT09160, No. BAG71007 and No. AAL92562).

Because the delta-5 desaturase substrate (i.e., DGLA, ETA) is highly hydrophobic, it was assumed to likely partition in the lipid bilayer. Similarly, it was assumed that the active site assembled from the three His-rich clusters would likely occur at or very near the membrane surface. Thus, the third and fourth transmembrane segments found between residues 165-187 and 234-256, respectively, that were originally predicted by TMHMM to span through the membrane were instead predicted to lie near the membrane surface to ensure that the active site was positioned close to the membrane. The transmembrane regions at amino acid residues 103-125, 130-152, 280-302 and 306-328 remained as predicted by TMHMM.

Figure 18:
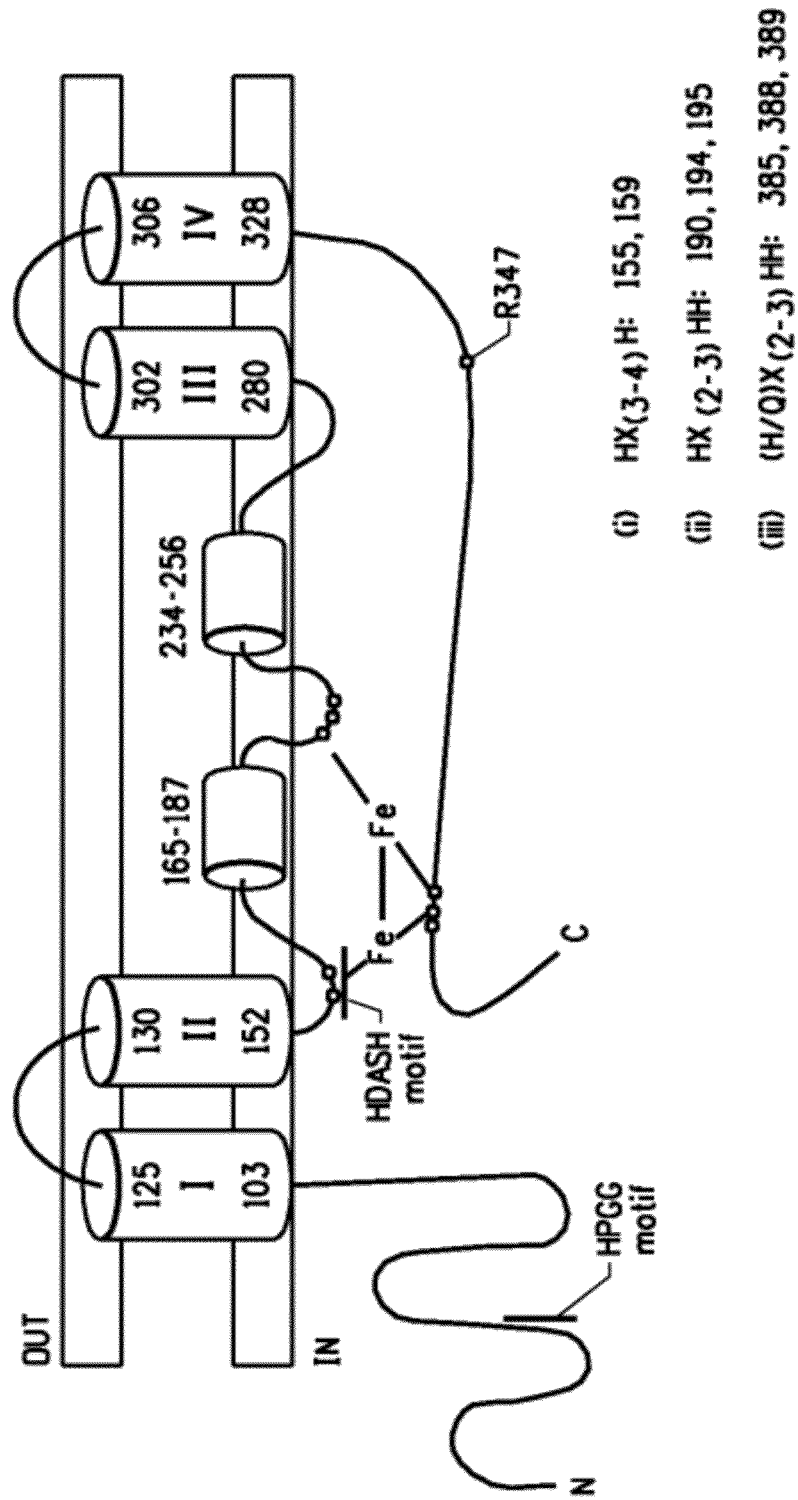
FIG. 18 is a predicted topological model of the *Euglena gracilis* delta-5 desaturase enzyme.

Thus, the final topology model predicted for EgD5 is shown in FIG. 18. The vertical cylinders indicate membrane spanning domains, while the horizontal cylinders indicate the two highly hydrophobic regions that are not membrane spanning, but lie near the inner membrane surface. The circles correspond to the His residues presumably involved in the active site. The locations of the HPGG (SEQ ID NO:181) motif and HDASH (SEQ ID NO:183) motif are also identified. Finally, "IN" corresponds with the cytoplasmid space while "OUT" corresponds with the periplasmic space.

Example 11B

Determination of Natural HDASH (SEQ ID NO:183) Motif Variation in Desaturases

Selected desaturase protein sequences were examined to determine whether natural variation occurred within the HDASH (SEQ ID NO:183) motif. Specifically, the desaturase proteins included the *Euglena gracilis* delta-5 desaturase ["EgD5"; U.S. Pat. No. 7,678,560], the *Morteriella alpina* delta-5 desaturase ["MaD5"; U.S. Pat. No. 5,972,664], and BLAST hits to other known delta-5 desaturases and/or delta-6 desaturases that are known to be closely related to delta-5 desaturases. The selected sequences were aligned using the MegAlign™ program of the LASERGENE bioinformatics computing suite (DNASTAR Inc., Madison, Wis.), and the HDASH motif (or variant thereof) is summarized below in Table 32.

TABLE 32

Natural Variants Of The HDASH (SEQ ID NO: 183) Motif

| GenBank Accession No. or Patent Number | Organism | Variant HDASH Motif | SEQ ID NO |
|---|---|---|---|
| CBL59059.1 (gi_295016816) | *Mortierella alpina* | HDASH | 183 |
| CAL49887.1 (gi_116001271) | *Phytophthora sojae* | HDASH | 183 |
| CBL59057.1 (gi_295016812) | *Physcomitrella patens* | HDgnH | 380 |
| CAT16395.1 (gi_218101624) | *Euglena gracilis* | HDASH | 183 |
| CBL59055.1 (gi_295016808) | *Phaeodactylum tricornutum* | HDAnH | 381 |
| CBL59102.1 (gi_295016902) | *Thalassiosira pseudonana* | HDAnH | 381 |
| CAM55833.1 (gi_126633754) | *Thalassiosira pseudonana* | HDAnH | 381 |
| AAL13311.1 (gi_16033740) | *Pythium irregulare* | HDsSH | 430 |
| CAD53323.1 (gi_23894018) | *Phytophthora megasperma* | HDASH | 183 |
| BAD95486.1 (gi_62484905) | *Mortierella alpina* | HDASH | 183 |
| NP_501751.1 (gi_17542396) | *Caenorhabditis elegans* | HefaH | 382 |
| CAE65324.1 (gi_39585564) | *Caenorhabditis briggsae* | HeftH | 383 |
| AAM09687.1 (gi_20069123) | *Thraustochytrium* sp. ATCC 21685 | HemgH | 384 |

TABLE 32-continued

Natural Variants Of The HDASH (SEQ ID NO: 183) Motif

| GenBank Accession No. or Patent Number | Organism | Variant HDASH Motif | SEQ ID NO |
|---|---|---|---|
| CAJ07076.1 (gi__68124314) | *Leishmania major* strain Friedlin | HeAgH | 385 |
| AAH26831.1 (gi__20070924) | *Mus musculus* | HDfgH | 386 |
| NP__571720.2 (gi__42476248) | *Danio rerio* | HDfgH | 386 |
| AAL82631.2 (gi__55846441) | *Salmo salar* | HDygH | 387 |
| AAL92562.1 (gi__19879687) | *Phaeodactylum tricornutum* | HDAnH | 381 |
| AAX14502.1 (gi__60172920) | *Thalassiosira pseudonana* | HDAnH | 381 |
| AAT09160.1 (gi__47028617) | *Nitzschia closterium* f. *minutissima* | HDAnH | 381 |
| AAT85663.1 (gi__50882495) | *Marchantia polymorpha* | HDgnH | 380 |
| XP__638329.1 (gi__66809213) | *Dictyostelium discoideum* AX4 | HDscH | 388 |
| XP__640331.1 (gi__66812304) | *Dictyostelium discoideum* AX4 | HDAcH | 389 |
| U.S. Pat. No. 7,678,560 | *Euglena gracilis* | HDASH | 183 |
| U.S. Pat. No. 5,972,664 | *Morteriella alpina* | HDASH | 183 |

Based on the above analysis, it appeared that the Asp ["D"] residue of the HDASH (SEQ ID NO:183) motif could possibly be substituted with a Glu residue ["E"], the Ala ["A"] residue could possibly be substituted with a Gly ["G"], Ser ["S"], Phe ["F"], Tyr ["Y"] or Met ["M"] residue and/or the Ser ["S"] residue of the HDASH (SEQ ID NO:183) motif could possibly be substituted with a Cys ["C"], Asn ["N"], Gly ["G"], Ala ["A"] or Thr [T"] residue.

Example 11C

Sequence of Wild-Type *Euglena gracilis* Delta-5 Desaturase ["EgD5"]

U.S. Pat. No. 7,678,560 describes the isolation and cloning of a delta-5 desaturase from *E. gracilis* (i.e., EgD5, SEQ ID NO:185). Recently, more detailed analyses of the cloned EgD5 therein have identified one more variant "wildtype" *E. gracilis* delta-5 desaturase sequence, designated as EgD5R and set forth herein as SEQ ID NOs:192 and 193, that was previously not appreciated. Instead of a Ser residue at position 347 of EgD5 as described in U.S. Pat. No. 7,678,560, EgD5R (SEQ ID NO:193) comprises an Arg residue at position 347. It is hypothesized that this discrepancy arose as a result of PCR or cDNA generation methodologies.

Specifically, EgD5 (SEQ ID NO:184, corresponding to SEQ ID NO:1 of U.S. Pat. No. 7,678,560) was obtained using 5'- and 3'-RACE techniques with double-stranded cDNA of *E. gracilis* as the template (Examples 4-5 of U.S. Pat. No. 7,678,560). Then, the ORF encoding the *E. gracilis* delta-5 desaturase was amplified by PCR using *E. gracilis* cDNA as the template, purified, subjected to restriction digestion and then directionally ligated into an appropriate vector to yield pDMW367 (Example 6 of U.S. Pat. No. 7,678,560). The sequence of pDMW367 was provided as SEQ ID NO:23 in U.S. Pat. No. 7,678,560 (corresponding to SEQ ID NO:194 herein). Although it was reported in U.S. Pat. No. 7,678,560 that pDMW367 comprised a chimeric FBAIN::EgD5::Pex20 gene, it is now appreciated that the delta-5 desaturase sequence within this chimeric gene was actually the nucleotide sequence of EgD5R (SEQ ID NO:192).

An alignment of EgD5 (SEQ ID NO:184) and EgD5R (SEQ ID NO:192) (FIGS. 19A and 19B) shows four nucleotide differences, wherein the mutations with respect to SEQ ID NO:184 are G819GA, T948C, C1041A and G1349A. The G1349A mutation is attributed to the specific primer sequence utilized to amplify EgD5 for cloning into pDMW367. Alignment of the translated products of EgD5 (SEQ ID NO:185) and EgD5R (i.e., SEQ ID NO:193) reveals a single amino acid difference, i.e., the S347R mutation.

U.S. Pat. No. 7,678,560, Example 9 also describes the creation of a synthetic delta-5 desaturase derived from EgD5 and codon-optimized for expression in *Y. lipolytica* (i.e., EgD5S; SEQ ID NOs:195 and 196). Codon-optimization of EgD5 resulted in modification of 196 bp of the 1350 bp coding region (14.5%) and optimization of 189 codons of the total 449 codons (42%). The protein sequence encoded by the codon-optimized EgD5S gene (i.e., SEQ ID NO:196) was identical to that of the wildtype protein sequence (i.e., SEQ ID NO:185), wherein the amino acid at 347 position is Ser.

Example 11D

Generation of Construct pDMW367-M4, Comprising Wild-Type EgD5R with Four Restriction Endonuclease Sites Eliminated ["EgD5R*"]

The present Example describes the construction of plasmid pDMW367-M4 (FIGS. 20A, 20B and 20C), comprising a chimeric FBAIN::EgD5R*::Pex20 gene. EgD5R* (SEQ ID NO:197) was a modified variant of wildtype EgD5R (SEQ ID NO:192) created to facilitate subsequent cloning procedures, wherein the modifications resulted in removal of four restriction enzymes sites (i.e., EcoRI, HindIII, BglII and NcoI) from the wildtype EgD5R coding region. The amino acid sequences of EgD5R (SEQ ID NO:193) and EgD5R* (SEQ ID NO:198) are identical.

Specifically, plasmid pDMW367-M4 (SEQ ID NO:199; FIG. 20C) was derived from pDMW367 (SEQ ID NO:194, Example 11C; FIG. 20A). The native EcoRI, HindIII, BglII and NcoI restriction enzymes sites were sequentially eliminated from the EgD5R coding region to generate pDMW367-M4. First, the EcoRI and BglII sites were eliminated by in vitro mutagenesis using pDMW367 (SEQ ID NO:194) as template, and two pairs of oligonucleotides as primers. Primer pair YL813 (SEQ ID NO:200) and YL814 (SEQ ID NO:201) enabled mutation of the EcoI site, while primer pair YL815 (SEQ ID NO:202) and YL816 (SEQ ID NO:203) enabled mutation of the BglII site. These reactions generated construct pDMW367-M2 (FIG. 20B; SEQ ID NO:204). Sequence analysis confirmed that the amino acid sequence of the variant EgD5R in pDMW367-M2 was identical to the amino acid sequence of EgD5R in pDMW367.

Then, the HindIII and NcoI sites were eliminated by in vitro mutagenesis using pDMW367-M2 as template, and two pairs of oligonucleotides as primers. Primer pair YL829 (SEQ ID NO:205) and YL830 (SEQ ID NO:206) enabled mutation of the HindIII site, while primer pair YL831 (SEQ ID NO:207) and YL832 (SEQ ID NO:208) enabled mutation of the NcoI site. This resulted in generation of pDMW367-M4. Again, sequence analysis confirmed that the amino acid sequence of the variant EgD5 (i.e., EgD5R*) in pDMW367-M4 was identical to the amino acid sequence of EgD5R in pDMW367.

For subsequent examples, reference to the wildtype EgD5 will effectively include reference to EgD5R (SEQ ID NOs: 192 and 193) and EgD5R* (SEQ ID NOs:197 and 198), unless otherwise specified.

Example 11E

Identification of HDxSH (SEQ ID NO:434) Mutations that Result in Similar Delta-5 Desaturase Activity to the Delta-5 Desaturase Activity Of EgD5R*

The HDASH (SEQ ID NO:183) motif spans from amino acid residues 155 to 159 of EgD5R* (SEQ ID NO:198). Single amino acid mutations were carried out using pDMW367-M4 (Example 11D) as the template and 19 pairs of oligonucleotides (SEQ ID NOs:209-246; Table 33, infra) as primers to individually mutate the Ala residue of the HDASH (SEQ ID NO:183) motif of EgD5R* by site-directed mutagenesis (QuickChange Kit, Stratagene, Calif.), thereby generating all amino acid substitutions possible (i.e., HDxSH [SEQ ID NO:434] mutants). Plasmids from each mutation were transformed into E. coli XL2Blue cells. Three colonies from each of the 19 transformations were picked and grown individually in liquid media at 37° C. overnight. Plasmids (i.e., 57 total) were isolated from these cultures and sequenced individually to confirm the mutations.

The wild type pDMW367-M4 plasmid and the isolated mutant plasmids were transformed into Y. lipolytica strain Y4036U1 individually, as described in the General Methods. The transformants were selected on MMLeu plates. After 2 days growth at 30° C., three transformants from each transformation reaction were streaked out onto new MMLeu plates and incubated for an additional 2 days at 30° C. The colonies were then used to inoculate 3 mL of MMLeu in a 24 well Qiagen block. The blocks were incubated in a 30° C. incubator shaking at 200 rpm. After the cultures were incubated for 2 days, the blocks were centrifuged, the supernatant was removed and 3 mL of HGM was added. The blocks were placed back in a 30° C. incubator shaking at 200 rpm for an additional 5 days. The cells were collected by centrifugation, lipids were extracted, and fatty acid methyl esters ["FAMEs"] were prepared by trans-esterification, and subsequently analyzed with a Hewlett-Packard 6890 GC.

The delta-5 desaturase activity (average of 3 transformants) attributed to each mutant HDASH (SEQ ID NO:183) motif is summarized below in Table 33. Transformants comprising mutant pDMW367M4 constructs, wherein the mutant constructs comprise EgD5R* mutants, are designated according to the amino acid substitution that occurred for the Ala residue at position 157 within EgD5R* (i.e., transformant pDMW367M4-157c comprises a mutant delta-5 desaturase designated as EgD5R*-157c, and having a Cys for Ala substitution at position 157, thereby yielding a HDcSH [SEQ ID NO:390] motif; transformant pDMW367M4-157g comprises a mutant delta-5 desaturase designated as EgD5R*-157g, and having a Gly for Ala substitution, thereby yielding a HDgSH [SEQ ID NO:429 motif, etc.). The conversion efficiency ("Avg. Conv. Effic.") was measured according to the following formula: ([product]/[substrate+product])*100, where 'product' includes the immediate product and all products in the pathway derived from it. Results are compared to that of the wildtype EgD5R* (SEQ ID NO:198) within plasmid pDMW367-M4, wherein GC analysis determined 10.8% DGLA and 3.6% ARA of total lipids were produced by the transformants (i.e., average conversion efficiency was 24.8%).

TABLE 33

Delta-5 Desaturase Activity In EgD5R* And HDxSH (SEQ ID NO: 434) Motif Mutants

| Y4036U1 Transformant * | SEQ ID NOs Of Primers | Sequence of Mutant HDASH Motif | Avg. Conv. Effic. | Percent Activity ** |
|---|---|---|---|---|
| pDMW367-M4 | — | HDASH (SEQ ID NO: 183) | 24.8% | 100 |
| pDMW367M4-157c | 209 and 210 | HDcSH (SEQ ID NO: 390) | 10.7% | 43.1% |
| pDMW367M4-157d | 211 and 212 | HDdSH (SEQ ID NO: 391) | 1.0% | 4.0% |
| pDMW367M4-157e | 213 and 214 | HDeSH (SEQ ID NO: 392) | 0.9% | 3.6% |
| pDMW367M4-157f | 215 and 216 | HDfSH (SEQ ID NO: 393) | 1.0% | 4.0% |
| pDMW367M4-157g | 217 and 218 | HDgSH (SEQ ID NO: 429) | 23.8% | 96% |
| pDMW367M4-157h | 219 and 220 | HDhSH (SEQ ID NO: 394) | 1.0% | 4.0% |

TABLE 33-continued

Delta-5 Desaturase Activity In EgD5R* And HDxSH (SEQ ID NO: 434) Motif Mutants

| Y4036U1 Transformant * | SEQ ID NOs Of Primers | Sequence of Mutant HDASH Motif | Avg. Conv. Effic. | Percent Activity ** |
|---|---|---|---|---|
| pDMW367M4-157i | 221 and 222 | HDiSH (SEQ ID NO: 395) | 0.9% | 3.6% |
| pDMW367M4-157k | 223 and 224 | HDkSH (SEQ ID NO: 396) | 1.0% | 4.0% |
| pDMW367M4-157I | 225 and 226 | HDlSH (SEQ ID NO: 397) | 1.1% | 4.4% |
| pDMW367M4-157m | 227 and 228 | HDmSH (SEQ ID NO: 398) | 1.0% | 4.0% |
| pDMW367M4-157n | 229 and 230 | HDnSH (SEQ ID NO: 399) | 1.1% | 4.4% |
| pDMW367M4-157p | 231 and 232 | HDpSH (SEQ ID NO: 400) | 2.3% | 9.3% |
| pDMW367M4-157q | 233 and 234 | HDqSH (SEQ ID NO: 401) | 0.6% | 2.4% |
| pDMW367M4-157r | 235 and 236 | HDrSH (SEQ ID NO: 402) | 0.8% | 3.2% |
| pDMW367M4-157s | 237 and 238 | HDsSH (SEQ ID NO: 430) | 23.3% | 94% |
| pDMW367M4-157t | 239 and 240 | HDtSH (SEQ ID NO: 403) | 1.0% | 4.0% |
| pDMW367M4-157v | 241 and 242 | HDvSH (SEQ ID NO: 404) | 0.3% | 1.2% |
| pDMW367M4-157w | 243 and 244 | HDwSH (SEQ ID NO: 405) | 0.9% | 3.6% |
| pDMW367M4-157y | 245 and 246 | HDySH (SEQ ID NO: 406) | 0.7% | 2.8% |

\* Each EgD5R* gene (mutant or wildtype) was expressed within pDMW367-M4.
\*\* Percent Activity is with respect to EgD5R*.

Based on the above, it is clear that the Ala residue within the HDASH (SEQ ID NO:183) motif can be substituted with either Gly or Ser without substantially affecting the delta-5 desaturase activity of EgD5R*. Specifically, EgD5R*-157g (SEQ ID NO:247) in pDMW367M4-157g transformants was able to convert DGLA to ARA with 23.8% conversion efficiency, while EgD5R*-157s (SEQ ID NO:248) in pDMW367M4-157s transformants was able to convert DGLA to ARA with 23.3% conversion efficiency.

Example 11F

Identification of HDAxH (SEQ ID NO:435) Mutations that Result in Similar Delta-5 Desaturase Activity to the Delta-5 Desaturase Activity of EgD5R*

Single amino acid mutations were carried out using pDMW367-M4 (Example 11D) as the template and 19 pairs of oligonucleotides (SEQ ID NOs:249-286; Table 34, infra) as primers to individually mutate the Ser residue of the HDASH (SEQ ID NO:183) motif of EgD5R* (SEQ ID NO:198) by site-directed mutagenesis (QuickChange Kit, Stratagene, Calif.), thereby generating all amino acid substitutions possible (i.e., HDAxH [SEQ ID NO:435] mutants). Following mutagenesis, plasmids were transformed into Yarrowia lipolytica Y4036U1, transformants were selected and grown in MMLeu and HGM, and FAMEs were prepared and analyzed by GC, as described in Example 11E.

The delta-5 desaturase activity (average of 3 transformants) attributed to each mutation within the HDASH (SEQ ID NO:183) motif is summarized below in Table 34. Transformants comprising mutant pDMW367M4 constructs, wherein the mutant constructs comprise EgD5R* mutants, are designated according to the amino acid substitution that occurred for the Ser residue at position 158 within EgD5R* (i.e., transformant pDMW367M4-158a comprises a mutant delta-5 desaturase designated as EgD5R*-158a, and having an Ala for Ser substitution at position 158, thereby yielding a HDAaH [SEQ ID NO:431] motif; transformant pDMW367M4-158r comprises a mutant delta-5 desaturase designated as EgD5R*-158r, and having an Arg for Ser substitution, thereby yielding a HDArH [SEQ ID NO:419] motif, etc.). Conversion efficiency was measured according to the formula described in Example 11E. Results are compared to that of the wildtype EgD5R* (SEQ ID NO:198) within plasmid pDMW367-M4, wherein GC analysis determined 11.3%

DGLA and 3.4% ARA of total lipids were produced by the transformants (i.e., average conversion efficiency was 23.3%).

delta-5 desaturase activity of EgD5R*. Specifically, EgD5R*-158a (SEQ ID NO:287) in pDMW367M4-158a transformants was able to convert DGLA to ARA with 23.5%

TABLE 34

Delta-5 Desaturase Activity In EgD5R* And HDAxH (SEQ ID NO: 435) Motif Mutants

| Y4036U1 Transformant * | SEQ ID NOs Of Primers | Sequence of Mutant HDASH Motif | Avg. Conv. Effic. | Percent Activity ** |
|---|---|---|---|---|
| pDMW367-M4 | — | HDASH (SEQ ID NO: 183) | 23.3% | 100% |
| pDMW367M4-158a | 249 and 250 | HDAaH (SEQ ID NO: 431) | 23.5% | 100.9% |
| pDMW367M4-158c | 251 and 252 | HDAcH (SEQ ID NO: 407) | 17.9% | 76.8% |
| pDMW367M4-158d | 253 and 254 | HDAdH (SEQ ID NO: 408) | 2.8% | 12.0% |
| pDMW367M4-158e | 255 and 256 | HDAeH (SEQ ID NO: 409) | 1.9% | 8.2% |
| pDMW367M4-158f | 257 and 258 | HDAfH (SEQ ID NO: 410) | 1% | 4.3% |
| pDMW367M4-158g | 259 and 260 | HDAgH (SEQ ID NO: 432) | 25.1% | 107.7% |
| pDMW367M4-158h | 261 and 262 | HDAhH (SEQ ID NO: 411) | 1.6% | 6.9% |
| pDMW367M4-158i | 263 and 264 | HDAiH (SEQ ID NO: 412) | 1.1% | 4.7% |
| pDMW367M4-158k | 265 and 266 | HDAkH (SEQ ID NO: 413) | 1% | 4.3% |
| pDMW367M4-158l | 267 and 268 | HDAlH (SEQ ID NO: 414) | 1.1% | 4.7% |
| pDMW367M4-158m | 269 and 270 | HDAmH (SEQ ID NO: 415) | 2.3% | 9.9% |
| pDMW367M4-158n | 271 and 272 | HDAnH (SEQ ID NO: 416) | 16.5% | 70.8% |
| pDMW367M4-158p | 273 and 274 | HDApH (SEQ ID NO: 417) | 1.2% | 5.2% |
| pDMW367M4-158q | 275 and 276 | HDAqH (SEQ ID NO: 418) | 10.4% | 44.6% |
| pDMW367M4-158r | 277 and 278 | HDArH (SEQ ID NO: 419) | 10.0% | 42.9% |
| pDMW367M4-158t | 279 and 280 | HDAtH (SEQ ID NO: 420) | 9.6% | 41.2% |
| pDMW367M4-158v | 281 and 282 | HDAvH (SEQ ID NO: 421) | 1.5% | 6.4% |
| pDMW367M4-158w | 283 and 284 | HDAwH (SEQ ID NO: 422) | 9.3% | 40.0% |
| pDMW367M4-158y | 285 and 286 | HDAyH (SEQ ID NO: 423) | 1.1% | 4.7% |

*Each EgD5R* gene (mutant or wildtype) was expressed within pDMW367-M4.
**Percent Activity is with respect to EgD5R*.

The results demonstrated that the Ser residue within the HDASH (SEQ ID NO:183) motif can be substituted with either an Ala or a Gly without substantially affecting the conversion efficiency, while EgD5R*-158g (SEQ ID NO:288) in pDMW367M4-158g transformants was able to convert DGLA to ARA with 25.1% conversion efficiency.

Example 11G

Identification of HxGx (SEQ ID NO:180) and HDxxH (SEQ ID NO:424) Mutations that Result in Similar Delta-5 Desaturase Activity to the Delta-5 Desaturase Activity of EgD5R*

U.S. Pat. Pub. No. 2010-0075386-A1 describes mutant delta-5 desaturases which possess at least one mutation within the HPGG (SEQ ID NO:181) motif of the cytochrome $b_5$-like domain (i.e., HxGx [SEQ ID NO:180] mutations). The HPGG (SEQ ID NO:181) motif spans from amino acid residues 33 to 36 of EgD5R* (SEQ ID NO:198).

The present Example introduces mutations within the HPGG (SEQ ID NO:181) motif of EgD5R*-157g (Example 11E, SEQ ID NO:247), EgD5R*-158a (Example 11F, SEQ ID NO:287) and EgD5R*-158g (Example 11F, SEQ ID NO:288) to see the effect of double mutations within the HPGG (SEQ ID NO:181) and HDASH (SEQ ID NO:183) domains.

Single amino acid mutations were carried out using pDMW367M4-157g (Example 11E, SEQ ID NO:289), pDMW367M4-158a (Example 11F, SEQ ID NO:290) and pDMW367-158g (Example 11F, SEQ ID NO:291) as the template and several pairs of oligonucleotides (SEQ ID NOs: 292-297; Table 35) as primers to individually mutate either the Pro residue or the second Gly residue of the HPGG (SEQ ID NO:181) motif of the mutant delta-5 desaturase gene by site-directed mutagenesis (QuickChange Kit, Stratagene, Calif.), thereby generating double mutations within the HPGG (SEQ ID NO:181) and HDASH (SEQ ID NO:183) motifs. Following mutagenesis, plasmids were transformed into *Y. lipolytica* strain Y4036U1, transformants were selected and grown in MMLeu and HGM, and FAMEs were prepared and analyzed by GC, as described in Example 11E.

The delta-5 desaturase activity of mutant delta-5 desaturases with both HxGx (SEQ ID NO:180) and HDxxH (SEQ ID NO:424) mutations are summarized below in Table 35. Transformants comprising mutant pDMW367M4 constructs, wherein the mutant constructs comprise EgD5R* mutants, are designated according to the amino acid substitution for the Pro residue or the second Gly residue within the HPGG (SEQ ID NO:181) motif of EgD5R*, combined with the amino acid substitution for the Ala residue or Ser residue within the HDASH (SEQ ID NO:183) motif of EgD5R*. That is, e.g., transformant pDMW367-34g158g comprises a mutant delta-5 desaturase designated as EgD5R*-34g158g, having a Gly for Pro substitution at position 34 (thereby yielding a HgGG [SEQ ID NO:425] motif) and having a Gly for Ser substitution at position 158 (thereby yielding a HDAgH [SEQ ID NO:432] motif), etc. Conversion efficiency was measured according to the formula described in Example 11E. Results are compared to that of the wild-type EgD5R* within plasmid pDMW367-M4, wherein GC analysis determined 11.7% DGLA and 4.4% ARA of total lipids were produced by the transformants (i.e., average conversion efficiency was 27.5%).

TABLE 35

Delta-5 Desaturase Activity In EgD5R* Mutants Simultaneously Comprising HxGx (SEQ ID NO: 180) And HDxxH (SEQ ID NO: 424) Motifs

| Y4036U1 Transformant | Mutant Gene | SEQ ID NOs Of Primers | Sequence Of Mutant HPGG Motif | Sequence Of Mutant HDASH Motif | Average Conversion Efficiency | Percent Activity With Respect to EgD5R* |
|---|---|---|---|---|---|---|
| pDMW367-M4 | — | — | HPGG (SEQ ID NO: 181) | HDASH (SEQ ID NO: 183) | 27.5% | 100% |
| pDMW367-34g157g | EgD5R*-34g157g (SEQ ID NO: 298) | 292 and 293 | HgGG (SEQ ID NO: 425) | HDgSH (SEQ ID NO: 429) | 22.9% | 83% |
| pDMW367-34g158a | EgD5R*-34g158a (SEQ ID NO: 300) | 292 and 293 | HgGG (SEQ ID NO: 425) | HDAaH (SEQ ID NO: 431) | 24.3% | 88% |
| pDMW367-34g158g | EgD5R*-34g158g (SEQ ID NO: 302) | 292 and 293 | HgGG (SEQ ID NO: 425) | HDAgH (SEQ ID NO: 432) | 26.8% | 97% |
| pDMW367-34h158a | EgD5R*-34h158a | 294 and 295 | HhGG (SEQ ID NO: 426) | HDAaH (SEQ ID NO: 431) | 18.7% | 68% |
| pDMW367-34h158g | EgD5R*-34h158g | 294 and 295 | HhGG (SEQ ID NO: 426) | HDAgH (SEQ ID NO: 432) | 22% | 80% |
| pDMW367-36s158a | EgD5R*-34s158a | 296 and 297 | HPGs (SEQ ID ) NO: 427 | HDAaH (SEQ ID ) NO: 431 | 17.5% | 64% |
| pDMW367-36s158g | EgD5R*-34s158g | 296 and 297 | HPGs (SEQ ID NO: 427) | HDAgH (SEQ ID ) NO: 432 | 18.9% | 69% |

*Each EgD5R* gene (mutant or wildtype) was expressed within pDMW367-M4.

The results demonstrated that although the HPGG (SEQ ID NO:181) motif and the HDASH (SEQ ID NO:183) motif are important to delta-5 desaturase enzymatic activity, desaturases may be constructed having HxGx (SEQ ID NO:180) and HDxxH (SEQ ID NO:424) motifs that retain at least 64% of delta-5 desaturase activity when compared to the wildtype. Specifically, the Pro residue within the HPGG (SEQ ID NO:181) motif can be substituted with Gly with simultaneous substitution of either: 1) the Ala residue within the HDASH (SEQ ID NO:183) motif for Gly; or, 2) the Ser residue within the HDASH (SEQ ID NO:183) motif for Ala or Gly. The Pro residue within the HPGG (SEQ ID NO:181) motif can also be substituted with His with simultaneous substitution of the Ser residue within the HDASH (SEQ ID NO:183) motif for either Ala or a Gly. And, the second Gly residue within the HPGG (SEQ ID NO:181) motif can be substituted with Ser with simultaneous substitution of Ser within the HDASH (SEQ ID NO:183) motif for either Ala or Gly.

Preferred double mutants were EgD5R*-34g157g (SEQ ID NOs:298 and 299; capable of converting DGLA to ARA with 22.9% conversion efficiency in pDMW367-34g157g transformants), EgD5R*-34g158a (SEQ ID NOs:300 and 301; capable of converting DGLA to ARA with 24.3% conversion efficiency in pDMW367-34g158a transformants) and EgD5R*-34g158g (SEQ ID NOs:302 and 303; capable of converting DGLA to ARA with 26.8% conversion efficiency in pDMW367-34g158g transformants).

Example 11H

Synthesis of an N-Terminal Codon-Optimized Mutant Delta-5 Desaturase Gene ("EgD5M") for Expression in *Yarrowia lipolytica*, Derived from EgD5R*-34g158g The codon usage of the 5' portion of EgD5R*-34g158g (SEQ ID NO:302, Example 11G) was optimized for expression in *Y. lipolytica*, in a manner similar to that described in U.S. Pat. No. 7,125,672. Specifically, the first 204 bp of EgD5R*-34g158g were codon-optimized, to result in synthesis of a codon-optimized delta-5 desaturase gene designated "EgD5M" (SEQ ID NOs:105 and 106). EgD5M was designed based on the coding sequence of the delta-5 desaturase gene of EgD5R*-34g158g, according to the *Yarrowia* codon usage pattern (U.S. Pat. No. 7,125,672), the consensus sequence around the 'ATG' translation initiation codon, and the general rules of RNA stability (Guhaniyogi, G. and J. Brewer, *Gene*, 265(1-2):11-23 (2001)). In addition to modification of the translation initiation site, 52 bp of the 204 bp within the N-terminus of the coding region were modified (25.5%; FIG. 21), and 45 codons of the 68 amino acids within the N-terminus of the desaturase protein were optimized (66.2%). A NcoI site and NotI sites were incorporated around the translation initiation codon and after the stop codon of EgD5M, respectively. The protein sequence encoded by the codon-optimized EgD5M gene (i.e., SEQ ID NO:106) is identical to that of the wildtype EgD5R*-34g158g protein sequence (i.e., SEQ ID NO:303). The designed EgD5M gene (SEQ ID NO:105) was synthesized by GenScript Corporation (Piscataway, N.J.) and cloned into pUC57 (GenBank Accession No. Y14837) to generate pEgD5M (FIG. 22A; SEQ ID NO:304).

Example 11I

Generation of Construct pDMW367-5M, Comprising EgD5M

The present Example describes the construction of plasmid pDMW367-5M comprising a chimeric FBAIN::EgD5M:: Pex20 gene. Plasmid pDMW367-5M (FIG. 22B; SEQ ID NO:305) was constructed by replacing the NcoI/NotI EgD5R* fragment of pDMW367-M4 (FIG. 20C; SEQ ID NO:199) with the NcoI/NotI EgD5M fragment from pEgD5M (FIG. 22A; SEQ ID NO:304). The product of this ligation was pDMW367-5M, which thereby contained the following components:

TABLE 36

Components Of Plasmid pDMW367-5M (SEQ ID NO: 305)

| RE Sites And Nucleotides Within SEQ ID NO: 305 | Description Of Fragment And Chimeric Gene Component |
|---|---|
| EcoR I/BsiW I (6063-318) | FBAIN::EgD5M::Pex20, comprising: FBAIN: *Yarrowia lipolytica* FBAIN promoter (U.S. Pat. No. 7,202,356); EgD5M: synthetic mutant N-terminal codon-optimized EgD5R*-34g158g ["EgD5M"] delta-5 desaturase (SEQ ID NO: 105), derived from *Euglena gracilis*; Pex20: Pex20 terminator sequence of *Yarrowia* Pex20 gene (GenBank Accession No. AF054613) |
| 1354-474 | ColE1 plasmid origin of replication |
| 2284-1424 | ampicillin-resistance gene (Amp$^R$) for selection in *E. coli* |
| 3183-4476 | *Yarrowia* autonomous replication sequence (ARS18; GenBank Accession No. A17608) |
| 6020-4533 | *Yarrowia* Ura 3 gene (GenBank Accession No. AJ306421) |

Example 11J

Generation of Construct pDMW367-5M1, Comprising Variant "EgD5M1" of the N-Terminal Codon-Optimized Mutant Delta-5. Desaturase Gene The present Example describes the construction of plasmid pDMW367-5M1 (SEQ ID NO:307) comprising a chimeric FBAIN::EgD5M1::Pex20 gene. The nucleotide sequence of EgD5M1 (SEQ ID NO:107) is identical to that of EgD5M (SEQ ID NO:105), except the CGA codon for Arg at position 347 in EgD5M was changed to encode an AGC codon for Ser in EgD5M1. This modification was designed to analyze the effect of the R347S mutation (described in Example 11C) on delta-5 desaturase activity.

The designed EgD5M1 gene (also referred to as "EgD5R*-34g158g347s"; SEQ ID NO:107) was synthesized by GenScript Corporation (Piscataway, N.J.) and cloned into pUC57 (GenBank Accession No. Y14837) to generate pEgD5M1 (SEQ ID NO:306).

Plasmid pDMW367-5M1 (SEQ ID NO:307) was constructed by replacing the NcoI/NotI EgD5R* fragment of pDMW367-M4 (FIG. 20C; SEQ ID NO:199) with the NcoI/ NotI EgD5M1 fragment from pEgD5M1 (SEQ ID NO:306). The product of this ligation was pDMW367-5M1, comprising a chimeric FBAIN::EgD5M1::Pex20 gene.

Example 11K

Functional Analyses of EgD5M and EQD5M1 Delta-5 Desaturases in *Yarrowia lipolytica* Strain Y4036U1

Control plasmid pDMW367-M4 (SEQ ID NO:199; Example 11D) and plasmids pDMW367-5M (SEQ ID NO:305; Example 11I) and pDMW367-5M1 (SEQ ID NO:307; Example 11J) were each separately transformed into *Y. lipolytica* strain Y4036U1. Transformants were selected and grown in MMLeu and HGM, and FAMEs were prepared and analyzed by GC, as described in Example 11E.

The delta-5 desaturase activity (average of 3 transformants) of EgD5R*, EgD5M and EgD5M1 are summarized below in Table 37. Conversion efficiency ("Conv. Effic.") was measured according to the formula described in Example 11E. Results are compared to that of the wild-type EgD5R* (SEQ ID NO:198) within plasmid pDMW367-M4, wherein GC analysis determined 10.8% DGLA and 3.6% ARA of total lipids were produced by the transformants (i.e., average conversion efficiency was 24.8%).

TABLE 37

Delta-5 Desaturase Activity In EgD5R*, EgD5M And EgD5M1

| Plasmid Transformed into Y4036U1 | Delta-5 Desaturase | Sequence Of Mutant HPGG and HDASH Motifs | Amino Acid At Residue 347 | Conv. Effic. |
|---|---|---|---|---|
| pDMW367-M4 | EgD5R* (SEQ ID NOs: 197 and 198) | HPGG (SEQ ID NO: 181), HDASH (SEQ ID NO: 183) | R | 24.8% |
| pDMW367-5M | EgD5M (SEQ ID NOs: 105 and 106) | HgGG (SEQ ID NO: 425), HDAgH (SEQ ID NO: 432) | R | 26.5% |
| pDMW367-5M1 | EgD5M1 (SEQ ID NOs: 107 and 108) | HgGG (SEQ ID NO: 425), HDAgH (SEQ ID NO: 432) | S | 27.6% |

The results demonstrated that both EgD5M (SEQ ID NO:106) and EgD5M1 (SEQ ID NO:108) had higher delta-5 desaturase activity than the wild-type EgD5R* (SEQ ID NO:198). The improved delta-5 desaturase activity of EgD5M1, when compared to EgD5M, demonstrates that amino acid residue 347 does affect the protein's delta-5 desaturase activity, with a Ser preferred as opposed to Arg.

Example 11L

Identification of HPGs (SEQ ID NO:427) and HxxxH (SEQ ID NO:186) Mutations in a Synthetic Delta-5 Desaturase Gene ("EgD5S") Derived From *Euglena gracilis* and Codon-Optimized for Expression in *Yarrowia lipolytica*

The present Example introduces mutations within the HDASH (SEQ ID NO:183) motif of a mutant EgD5S-36s (or "EgD5S-HPGs") gene to determine the effect of double mutations within the HPGG (SEQ ID NO:181) and HDASH (SEQ ID NO:183) conserved domains.

EgD5S (SEQ ID NOs:195 and 196) is a synthetic delta-5 desaturase derived from EgD5 (Example 11C) and codon-optimized for expression in *Y. lipolytica* (U.S. Pat. No. 7,678, 560). Although the amino acid sequence of EgD5S was identical to EgD5, the nucleotide sequences differ; specifically, in addition to modification of the translation initiation site, 196 bp of the 1350 bp coding region were modified (14.5%) and 189 codons were optimized (42%). The GC content was reduced from 55.5% within the wild type gene (i.e., EgD5) to 54.4% within the synthetic gene (i.e., EgD5S). And, a NcoI site and NotI sites were incorporated around the translation initiation codon and after the stop codon of EgD5S, respectively.

Examples 1 through 4 of U.S. Pat. Pub. No. 2010-0075386-A1 describe the identification of mutant EgD5S-36s (SEQ ID NO:308), using EgD5S as a template in site-directed mutagenesis reactions targeted to modify the second Gly residue of the HPGG (SEQ ID NO:181) motif of EgD5S, which spans from amino acid residues 33 to 36 of the cytochome $b_5$-like domain (i.e., HPGx [SEQ ID NO:436] mutations). Thus, mutant EgD5S-36s comprised an HPGs (SEQ ID NO:427) motif, wherein the second Gly residue of the HPGG (SEQ ID NO:181) motif was substituted with Ser using EgD5S (SEQ ID NO:196) as a template. The delta-5 desaturase activity of EgD5S-36s (U.S. Pat. Pub. No. 2010-0075386-A1) was about 106.9% of the delta-5 desaturase activity of EgD5S. Plasmid pDMW369S (SEQ ID NO:309) contains the mutant EgD5S-36s gene; the vector components are similar to those of pDMW367-5M (FIG. 22B herein), with the exception of the mutant EgD5S-36s gene in place of the EgD5M gene).

Based on the successful generation of double EgD5R* mutants in Example 11G (i.e., simultaneously comprising mutant HPGG [SEQ ID NO:181] and mutant HDASH [SEQ ID NO:183] motifs), it was anticipated that similar HxxxH (SEQ ID NO:186) mutations would be tolerated when introduced into EgD5S-36s. Specifically, single amino acid mutations were carried out using pDMW369S (comprising a chimeric FBAIN::EgD5S-36S::Pex20 gene) as the template and 9 pairs of oligonucleotides (SEQ ID NOs:310-327; Table 38) as primers to individually mutate either the Asp, Ala or Ser residue within the HDASH (SEQ ID NO:183) motif of EgD5S-36s (SEQ ID NO:308) by site-directed mutagenesis (QuickChange Kit, Stratagene, Calif.), thereby generating 9 selected amino acid substitutions. Following mutagenesis, plasmids were transformed into *Y. lipolytica* strain Y4036U1, transformants were selected and grown in MMLeu and HGM, and FAMEs were prepared and analyzed by GC, as described in Example 11E.

The delta-5 desaturase activity (average of 3 transformants) of mutant delta-5 desaturases with both HPGs (SEQ ID NO:427) and HxxxH (SEQ ID NO:186) mutations are summarized below in Table 38. Transformants comprising mutant pDMW369S constructs, wherein the mutant constructs comprise mutants of EgD5S-36s, are designated according to the amino acid substitution that occurred for the Asp, Ala or Ser residue within the HDASH (SEQ ID NO:183) motif (i.e., transformant pDMW369s-156e comprises a mutant delta-5 desaturase designated as EgD5S-36s156e, and having a Glu for Asp substitution at position 156, thereby yielding a HeASH [SEQ ID NO:433] motif; transformant pDMW369s-157g comprises a mutant delta-5 desaturase designated as EgD5S-36s157g, and having a Gly for Ala substitution, thereby yielding a HDgSH [SEQ ID NO:429] motif, etc.). Conversion efficiency was measured according to the formula described in Example 11E. Results are compared to that of EgD5S-36S (SEQ ID NO:308) within plasmid pDMW369S, wherein GC analysis determined 8.1% DGLA and 6.8% ARA of total lipids were produced by the transformants (i.e., average conversion efficiency was 45.8%).

TABLE 38

Delta-5 Desaturase Activity In EgD5S Mutants Simultaneously Comprising HPGs (SEQ ID NO: 427) And HxxxH (SEQ ID NO: 186) Motifs

| Y4036U1 Transformant | Mutant Gene | SEQ ID NOs Of Primers | Sequence Of Mutant HDASH Motif | Average Conversion Efficiency | Percent Activity With Respect to EgD5S-36s |
|---|---|---|---|---|---|
| pDMW369S | EgD5S-36s (SEQ ID NO: 308) | — | HDASH (SEQ ID NO: 183) | 45.8% | 100% |
| pDMW369S-157f | EgD5S-36s157f | 310 and 311 | HDfSH (SEQ ID NO: 393) | 3.4% | 7.4% |
| pDMW369S-157m | EgD5S-36s157m | 312 and 313 | HDmSH (SEQ ID NO: 398) | 2.4% | 5.2% |
| pDMW369S-157g | EgD5S-36s157g (SEQ ID NO: 109) | 314 and 315 | HDgSH (SEQ ID NO: 429) | 36.6% | 79.9% |
| pDMW369S-157s | EgD5S-36s157s | 316 and 317 | HDsSH (SEQ ID NO: 430) | 17.9% | 39.1% |
| pDMW369S-158a | EgD5S-36s158a (SEQ ID NO: 330) | 318 and 319 | HDAaH (SEQ ID NO: 431) | 39.1% | 85.4% |
| pDMW369S-158n | EgD5S-36s158n | 320 and 321 | HDAnH (SEQ ID NO: 399) | 13.0% | 28.4% |
| pDMW369S-158t | EgD5S-36s158t | 322 and 323 | HDAtH (SEQ ID NO: 403) | 4.5% | 9.8% |
| pDMW369S-158g | EgD5S-36s158g (SEQ ID NO: 332) | 324 and 325 | HDAgH (SEQ ID NO: 432) | 34.3% | 74.9% |
| pDMW369S-156e | EgD5S-36s156e (SEQ ID NO: 328) | 326 and 327 | HeASH (SEQ ID NO: 433) | 36.2% | 79.0% |

The results demonstrated that the codon-optimized EgD5S delta-5 desaturase could be modified to comprise both mutant HPGG (SEQ ID NO:181) and mutant HDASH (SEQ ID NO:183) motifs, while still retaining reasonable delta-5 desaturase activity when compared to mutant EgD5S-36s having only a mutant HPGG motif (i.e., HPGs [SEQ ID NO:427]). Preferred double mutants were EgD5S-36s156e (SEQ ID NOs:328 and 329; capable of converting DGLA to ARA with 36.2% conversion efficiency in pDMW369S-156e transformants), EgD5S-36s157g (SEQ ID NOs:109 and 110; capable of converting DGLA to ARA with 36.6% conversion efficiency in pDMW369s-157g transformants), EgD5S-36s158a (SEQ ID NOs:330 and 331; capable of converting DGLA to ARA with 39.1% conversion efficiency in pDMW369s-158a transformants), and EgD5S-36s158g (SEQ ID NOs:332 and 333; capable of converting DGLA to ARA with 34.3% conversion efficiency in pDMW369s-158g transformants).

Example 11M

Identification of HaGG (SEQ ID NO:428) and HxxxH (SEQ ID NO:186) Mutations in a Synthetic Delta-5 Desaturase Gene ("EaD5S") Derived from *Euglena anabaena* and Codon-Optimized for Expression in *Yarrowia lipolytica*

The present Example introduces mutations within the HDASH (SEQ ID NO:183) motif of a mutant EaD5S-35a (or "EaD5S-HaGG") gene to determine the effect of double mutations within the HPGG (SEQ ID NO:181) and HDASH (SEQ ID NO:183) conserved domains.

U.S. Pat. No. 7,943,365 describes the isolation and cloning of a delta-5 desaturase from *E. anabaena* (i.e., EaD5; SEQ ID NOs:335 and 336). This gene was then codon-optimized for expression in *Y. lipolytica*, resulting in the synthetic delta-5 desaturase EaD5S (SEQ ID NOs:337 and 338). Although the amino acid sequence of EaD5S was identical to EaD5, the nucleotide sequences differ; specifically, in addition to modification of the translation initiation site, 183 bp of the 1362 bp coding region were modified (13.4%) and 174 codons were optimized (38.3%). The GC content was reduced from 57.6% within the wild type gene (i.e., EaD5; SEQ ID NO:335) to 54.6% within the synthetic gene (i.e., EaD5S; SEQ ID NO:337). And, NcoI site and NotI sites were incorporated around the translation initiation codon and after the stop codon of EaD5S, respectively.

Example 6 of U.S. Pat. Pub. No. 2010-0075386-A1 describes the identification of mutant EaD5S-35a (SEQ ID NO:334), using EaD5S as a template in site-directed mutagenesis reactions targeted to modify the Pro residue of the HPGG (SEQ ID NO:181) motif of EaD5S, which spans from amino acid residues 34 to 37 of the cytochome $b_5$-like domain (i.e., HxGG [SEQ ID NO:437] mutations). Thus, mutant EaD5S-35a (SEQ ID NO:334) comprised a HaGG (SEQ ID NO:428) motif, wherein the Pro residue of the HPGG (SEQ ID NO:181) motif was substituted with Ala using EaD5S (SEQ ID NO:338) as a template. The delta-5 desaturase activity of EaD5S-35a (U.S. Pat. Pub. No. 2010-0075386-A1) was about 99.2% of the delta-5 desaturase activity of the EaD5S. Plasmid pZuFmEaD5S-A(S) (SEQ ID NO:339) contains the mutant EaD5S-35a gene; the vector components are identical to those of pDMW367-5M (FIG. 22B herein; SEQ ID NO:305), with the exception of the mutant EaD5S-35a gene in place of the EgD5M gene).

Based on the successful generation of double EgD5R* mutants in Example 11G and double EgD5S mutants in Example 11L (i.e., simultaneously comprising mutant HPGG [SEQ ID NO:181] and mutant HDASH [SEQ ID NO:183] motifs), it was anticipated that similar HxxxH (SEQ ID NO:186) mutations would be tolerated when introduced into EaD5S-35a. The HDASH (SEQ ID NO:183) motif spans from amino acid residues 156-160 of EaD5S and EaD5S-35a.

Single amino acid mutations were carried out using pZuFmEaD5S-A(S) (comprising a chimeric FBAIN::EaD5S-35a::Pex20 gene) as the template and 9 pairs of oligonucleotides (SEQ ID NOs:340-361; Table 39) as primers to individually mutate Asp, Ala or Ser within the HDASH (SEQ ID NO:183) motif of EaD5S-35a (SEQ ID NO:334) by site-directed mutagenesis (QuickChange Kit, Stratagene, Calif.), thereby generating 9 selected amino acid substitutions. Following mutagenesis, plasmids were transformed into *Y. lipolytica* strain Y4036U1, transformants were selected and grown in MMLeu and HGM, and FAMEs were prepared and analyzed by GC, as described in Example 11E.

The delta-5 desaturase activity (average of 3 transformants) of mutant delta-5 desaturases comprising HaGG (SEQ ID NO:428) and HxxxH (SEQ ID NO:186) mutations are summarized below in Table 39. Transformants comprising mutant pZuFmEaD5S-A(S) constructs, wherein the mutant constructs comprise mutants of EaD5S-35a, are designated according to the amino acid substitution that occurred for the Asp, Ala or Ser residue within the HDASH (SEQ ID NO:183) motif. That is, e.g., transformant pZuFmEaD5S-A(S)-157e comprises a mutant delta-5 desaturase designated as EaD5S-35a157e, and having a Glu for Asp substitution at position 157, thereby yielding a HeASH (SEQ ID NO:433) motif; transformant pZuFmEaD5S-A(S)-158g comprises a mutant delta-5 desaturase designated as EaD5S-35a158g, and having a Gly for Ala substitution, thereby yielding a HDgSH (SEQ ID NO:429) motif, etc. Conversion efficiency was measured according to the formula described in Example 11E. Results are compared to that of EaD5S-35a (SEQ ID NO:334) within plasmid pZuFmEaD5S-A(S), wherein GC analysis determined 8.6% DGLA and 5.1% ARA of total lipids were produced by the transformants (i.e., average conversion efficiency was 37.2%).

TABLE 39

Delta-5 Desaturase Activity In EaD5S Mutants Simultaneously Comprising HaGG (SEQ ID NO: 428) And Mutant HxxxH (SEQ ID NO: 186) Motifs

| Y4036U1 Transformant | Mutant Gene | SEQ ID NOs Of Primers | Sequence Of Mutant HDASH Motif | Average Conversion Efficiency | Percent Activity With Respect to EaD5S-35a |
|---|---|---|---|---|---|
| pZuFmEaD5S-A(S) | EaD5S-35a (SEQ ID NO: 334) | — | HDASH (SEQ ID NO: 183) | 37.2% | 100% |
| pZuFmEaD5S-A(S)-157e | EaD5S-35a157e | 340 and 341 | HeASH (SEQ ID NO: 433) | 14.0% | 37.6% |
| pZuFmEaD5S-A(S)-158f | EaD5S-35a157f | 342 and 343 | HDfSH (SEQ ID NO: 393) | 2.1% | 5.6% |
| pZuFmEaD5S-A(S)-158g | EaD5S-35a158g (SEQ ID NO: 111) | 344 and 345 | HDgSH (SEQ ID NO: 429) | 28.4% | 76.3% |
| pZuFmEaD5S-A(S)-158m | EaD5S-35a 158m | 346 and 347 | HDmSH (SEQ ID NO: 398) | 1.8% | 4.8% |
| pZuFmEaD5S-A(S)-158s | EaD5S-35a158s (SEQ ID NO: 362) | 348 and 349 | HDsSH (SEQ ID NO: 430) | 27.4% | 73.7% |
| pZuFmEaD5S-A(S)-158y | EaD5S-35a158y | 350 and 351 | HDySH (SEQ ID NO: 406) | 1.9% | 5.1% |
| pZuFmEaD5S-A(S)-159a | EaD5S-35a159a | 352 and 353 | HDAaH (SEQ ID NO: 431) | 2.0% | 5.4% |
| pZuFmEaD5S-A(S)-159c | EaD5S-35a159c | 354 and 355 | HDAcH (SEQ ID NO: 407) | 14.2% | 38.2% |
| pZuFmEaD5S-A(S)-159g | EaD5S-35a159g (SEQ ID NO: 364) | 356 and 357 | HDAgH (SEQ ID NO: 432) | 26.5% | 71.2% |
| pZuFmEaD5S-A(S)-159n | EaD5S-35a159n | 358 and 359 | HDAnH (SEQ ID NO: 416) | 4.2% | 11.3% |
| pZuFmEaD5S-A(S)-159t | EaD5S-35a159t | 360 and 361 | HDAtH (SEQ ID NO: 420) | 9.8% | 26.3% |

The results demonstrated that the codon-optimized EaD5S delta-5 desaturase can be modified to comprise both mutant HPGG (SEQ ID NO:181) and mutant HDASH (SEQ ID NO:183) motifs, while still retaining reasonable delta-5 desaturase activity when compared to the mutant EaD5S-35a having only a mutant HPGG motif (i.e., HaGG [SEQ ID NO:428]). Preferred double mutants were EaD5S-35a158g (SEQ ID NOs:111 and 112; capable of converting DGLA to ARA with 28.4% conversion efficiency in pZuFmEaD5S-A(S)-158g transformants), EaD5S-35a158s (SEQ ID NOs:362 and 363; capable of converting DGLA to ARA with 27.4% conversion efficiency in pZuFmEaD5S-A(S)-158s transformants), and EaD5S-35a159g (SEQ ID NO:364 and 365; capable of converting DGLA to ARA with 26.5% conversion efficiency in pZuFmEaD5S-A(S)-159g transformants).

SEQUENCE LISTING (435 sequences)

SEQ ID NO: 1 - protein, 258 aa, Euglena gracilis
  MISC_FEATURE (1)..(258): mutant delta-9 elongase; EgD9eS-mutant consensus
  MISC_FEATURE (9)..(9): Xaa = Ser [S] (synthetic codon-optimized) or (Ala [A] or Asp [D] or Gly [G] or Ile [I] or Lys [K] or Gln [Q]) (mutant)
  MISC_FEATURE (12)..(12): Xaa =  Gln [Q] (synthetic codon-optimized) or Lys [K] (mutant)
  MISC_FEATURE (21)..(21): Xaa =  Ala [A] (synthetic codon-optimized) or (Asp [D] or Thr [T] or Val [V]) (mutant)
  MISC_FEATURE (32)..(32): Xaa =  Val [V] (synthetic codon-optimized) or Phe [F] (mutant)
  MISC_FEATURE (35)..(35): Xaa =  Leu [L] (synthetic codon-optimized) or (Phe [F] or Gly [G] or Met [M]) (mutant)
  MISC_FEATURE (58)..(58): Xaa =  Lys [K] (synthetic codon-optimized) or Arg [R] (mutant)
  MISC_FEATURE (84)..(84): Xaa =  Tyr [Y] (synthetic codon-optimized) or Cys [C] (mutant)
  MISC_FEATURE (98)..(98): Xaa =  Asp [D] (synthetic codon-optimized) or Gly [G] (mutant)
  MISC_FEATURE (107)..(107): Xaa =  Gln [Q] (synthetic codon-optimized) or Glu [E] (mutant)
  MISC_FEATURE (108)..(108): Xaa =  Leu [L] (synthetic codon-optimized) or Gly [G] (mutant)
  MISC_FEATURE (127)..(127): Xaa =  Gly [G] (synthetic codon-optimized) or Leu [L] (mutant)
  MISC_FEATURE (130)..(130): Xaa =  Leu [L] (synthetic codon-optimized) or Met [M] (mutant)
  MISC_FEATURE (132)..(132): Xaa =  Trp [W] (synthetic codon-optimized) or Thr [T] (mutant)
  MISC_FEATURE (143)..(143): Xaa =  Met [M] (synthetic codon-optimized) or (Asn [N] or Trp [W]) (mutant)
  MISC_FEATURE (161)..(161): Xaa =  Leu [L] (synthetic codon-optimized) or (Thr [T] or Tyr [Y]) (mutant)
  MISC_FEATURE (168)..(168): Xaa =  Trp [W] (synthetic codon-optimized) or Gly [G] (mutant)
  MISC_FEATURE (179)..(179): Xaa =  Ile [I] (synthetic codon-optimized) or (Met [M] or Arg [R]) (mutant)
  MISC_FEATURE (236)..(236): Xaa =  Cys [C] (synthetic codon-optimized) or Asn [N] (mutant)
  MISC_FEATURE (243)..(243): Xaa =  Val [V] (synthetic codon-optimized) or Ala [A] (mutant)
  MISC_FEATURE (244)..(244): Xaa =  Gln [Q] (synthetic codon-optimized) or Asn [N] (mutant)
  MISC_FEATURE (254)..(254): Xaa =  Ala [A] (synthetic codon-optimized) or (Trp [W] or Tyr [Y]) (mutant)
  MISC_FEATURE (257)..(257): Xaa =  Ile [I] (synthetic codon-optimized) or Thr [T] (mutant)
MEVVNEIVXIGXEVLPKVDYXQLWSDASHCEXLYXSIAFVILKFTLGPLGPKGQSRMXFVFTNYNLLMSIYSLGSFLSMAYAMXTIGVMSDNCEKAFXNNVFRITTXXFYLSKFLEYIDSFYLPLMXKPXTXLQFFHHLGAPXDMWLFYNYRNEAVWIFVXLNGFIHXIMYGYYWTRLXKLKFPMPKSLITSMQIIQFNVGFYIVWKYRNIPCYRQDGMRMFGWFFNYFYVGTVLXLFLNFYXXTYIVRKHKGXKKXQ

SEQ ID NO: 2 - DNA, 777 bp, Euglena gracilis
  CDS (1)..(777): synthetic delta-9 elongase (codon-optimized for Yarrowia lipolytica)
  ref <302>: TITLE: DELTA-9 ELONGASES AND THEIR USE IN MAKING POLYUNSATURATED FATTY ACIDS
  ref <310>: PATENT DOCUMENT NUMBER: WO 2007/061742
  ref <311>: PATENT FILING DATE: 2006-11-16
  ref <312>: PUBLICATION DATE: 2007-05-31
  ref <313>: RELEVANT RESIDUES IN SEQ ID NO: (1)..(777)
  ref <302>: TITLE: DELTA-9 ELONGASES AND THEIR USE IN MAKING POLYUNSATURATED FATTY ACIDS
  ref <310>: PATENT DOCUMENT NUMBER: US 7,645,604
  ref <311>: PATENT FILING DATE: 2006-11-16
  ref <312>: PUBLICATION DATE: 2010-01-12
  ref <313>: RELEVANT RESIDUES IN SEQ ID NO: (1)..(777)
atggaggtcgtgaacgaaatcgtctccattggccaggaggttcttcccaaggtcgactatgctcagctctggtctgatgcctcgcactgcgaggtgctgtacctctccatcgccttcgtcatcctgaagttcacccttggtcctctcggacccaagggtcagtctcgaatgaagtttgtgttcaccaactacaacctgctcatgtccatctactcgctgggctccttcctctctatggcctacgccatgtacaccattggtgtcatgtccgacaactgcgagaaggctttcgacaacaatgtcttccgaatcaccactcagctgttctacctcagcaagttcctcgagtacattgactccttctatctgcccctcatgggcaagcctctgacctggttgcagttctttcaccatctcggagctcctatggacatgtggctgttctacaactaccgaaacgaagccgtttggatctttgtgctgctcaacggcttcattcactggatcatgtacggctactattggacccgactgatcaagctcaagttccctatgcccaagtccctgattacttctatgcagatcattcagttcaacgttggcttctacatcgtctggaagtaccggaacattccctgctaccgacaagatggaatgagaatgtttggctggtttttcaactacttctacgttggtactgtcctgtgtctgttcctcaacttctacgtgcagacctacatcgtccgaaagcacaagggagccaaaaagattcagtga

SEQ ID NO: 3 - protein, 258 aa, Euglena gracilis
MEVVNEIVSIGQEVLPKVDYAQLWSDASHCEVLYLSIAFVILKFTLGPLGPKGQSRMKFVFTNYNLLMSIYSLGSFLSMAYAMYTIGVMSDNCEKAFDNNVFRITTQLFYLSKFLEYIDSFYLPLMGKPLTWLQFFHHLGAPMDMWLFYNYRNEAVWIFVLLNGFIHWIMYGYYWTRLIKLKFPMPKSLITSMQIIQFNVGFYIVWKYRNIPCYRQDGMRMFGWFFNYFYVGTVLCLFLNFYVQTYIVRKHKGAKKIQ

SEQ ID NO: 4 - protein, 24 aa, Artificial Sequence
  Multizyme linker
  ref <302>: TITLE: MULTIZYMES AND THEIR USE IN MAKING POLYUNSATURATED FATTY ACIDS
  ref <310>: PATENT DOCUMENT NUMBER: WO 2008/124048
  ref <311>: PATENT FILING DATE: 2008-04-03
  ref <312>: PUBLICATION DATE: 2008-10-16
  ref <313>: RELEVANT RESIDUES IN SEQ ID NO: (1)..(24)
  ref <302>: TITLE: MULTIZYMES AND THEIR USE IN MAKING POLYUNSATURATED FATTY ACIDS
  ref <310>: PATENT DOCUMENT NUMBER: US-2008-0254191-A1
  ref <311>: PATENT FILING DATE: 2008-04-03
  ref <312>: PUBLICATION DATE: 2008-10-16
  ref <313>: RELEVANT RESIDUES IN SEQ ID NO: (1)..(24)
GAGPARPAGLPPATYYDSLAVMGS

SEQ ID NO: 5 - protein, 19 aa, Artificial Sequence
  Multizyme linker
  ref <302>: TITLE: MULTIZYMES AND THEIR USE IN MAKING POLYUNSATURATED FATTY ACIDS
  ref <310>: PATENT DOCUMENT NUMBER: US-2008-0254191-A1
  ref <311>: PATENT FILING DATE: 2008-04-03
  ref <312>: PUBLICATION DATE: 2008-10-16
  ref <313>: RELEVANT RESIDUES IN SEQ ID NO: (1)..(19)
  ref <302>: TITLE: MULTIZYMES AND THEIR USE IN MAKING POLYUNSATURATED FATTY ACIDS
  ref <310>: PATENT DOCUMENT NUMBER: WO 2008/124048
  ref <311>: PATENT FILING DATE: 2008-04-03
  ref <312>: PUBLICATION DATE: 2008-10-16
  ref <313>: RELEVANT RESIDUES IN SEQ ID NO: (1)..(19)
GPARPAGLPPATYYDSLAV

SEQ ID NO: 6 - protein, 18 aa, Artificial Sequence
  Multizyme linker
  ref <302>: TITLE: MULTIZYMES AND THEIR USE IN MAKING POLYUNSATURATED FATTY ACIDS
  ref <310>: PATENT DOCUMENT NUMBER: WO 2008/124048
  ref <311>: PATENT FILING DATE: 2008-04-03
  ref <312>: PUBLICATION DATE: 2008-10-16
  ref <313>: RELEVANT RESIDUES IN SEQ ID NO: (1)..(18)
  ref <302>: TITLE: MULTIZYMES AND THEIR USE IN MAKING POLYUNSATURATED FATTY ACIDS
  ref <310>: PATENT DOCUMENT NUMBER: US-2008-0254191-A1
  ref <311>: PATENT FILING DATE: 2008-04-03
  ref <312>: PUBLICATION DATE: 2008-10-16
  ref <313>: RELEVANT RESIDUES IN SEQ ID NO: (1)..(18)
PARPAGLPPATYYDSLAV

SEQ ID NO: 7 - protein, 18 aa, Artificial Sequence
  Multizyme linker
  ref <302>: TITLE: MULTIZYMES AND THEIR USE IN MAKING POLYUNSATURATED FATTY ACIDS
  ref <310>: PATENT DOCUMENT NUMBER: WO 2008/124048
  ref <311>: PATENT FILING DATE: 2008-04-03
  ref <312>: PUBLICATION DATE: 2008-10-16
  ref <313>: RELEVANT RESIDUES IN SEQ ID NO: (1)..(18)
  ref <302>: TITLE: MULTIZYMES AND THEIR USE IN MAKING POLYUNSATURATED FATTY ACIDS
  ref <310>: PATENT DOCUMENT NUMBER: US-2008-0254191-A1
  ref <311>: PATENT FILING DATE: 2008-04-03
  ref <312>: PUBLICATION DATE: 2008-10-16
  ref <313>: RELEVANT RESIDUES IN SEQ ID NO: (1)..(18)
PTRPAGPPPATYYDSLAV

SEQ ID NO: 8 - protein, 33 aa, Artificial Sequence
  Multizyme linker
  ref <302>: TITLE: MULTIZYMES AND THEIR USE IN MAKING POLYUNSATURATED FATTY ACIDS
  ref <310>: PATENT DOCUMENT NUMBER: WO 2008/124048
  ref <311>: PATENT FILING DATE: 2008-04-03
  ref <312>: PUBLICATION DATE: 2008-10-16
  ref <313>: RELEVANT RESIDUES IN SEQ ID NO: (1)..(33)
  ref <302>: TITLE: MULTIZYMES AND THEIR USE IN MAKING POLYUNSATURATED FATTY ACIDS
  ref <310>: PATENT DOCUMENT NUMBER: US-2008-0254191-A1
  ref <311>: PATENT FILING DATE: 2008-04-03
  ref <312>: PUBLICATION DATE: 2008-10-16
  ref <313>: RELEVANT RESIDUES IN SEQ ID NO: (1)..(33)
PGGPGKPSEIASLPPPIRPVGNPPAAYYDALAT

SEQ ID NO: 9 - protein, 22 aa, Artificial Sequence
  Multizyme linker
  ref <302>: TITLE: MULTIZYMES AND THEIR USE IN MAKING POLYUNSATURATED FATTY ACIDS
  ref <310>: PATENT DOCUMENT NUMBER: WO 2008/124048
  ref <311>: PATENT FILING DATE: 2008-04-03
  ref <312>: PUBLICATION DATE: 2008-10-16
  ref <313>: RELEVANT RESIDUES IN SEQ ID NO: (1)..(22)
  ref <302>: TITLE: MULTIZYMES AND THEIR USE IN MAKING POLYUNSATURATED FATTY ACIDS
  ref <310>: PATENT DOCUMENT NUMBER: US-2008-0254191-A1
  ref <311>: PATENT FILING DATE: 2008-04-03
  ref <312>: PUBLICATION DATE: 2008-10-16
  ref <313>: RELEVANT RESIDUES IN SEQ ID NO: (1)..(22)
PARPAGLPPATYYDSLAVSGRT

SEQ ID NO: 10 - protein, 36 aa, Artificial Sequence
  Multizyme linker
  ref <302>: TITLE: MULTIZYMES AND THEIR USE IN MAKING POLYUNSATURATED FATTY ACIDS
  ref <310>: PATENT DOCUMENT NUMBER: WO 2008/124048
  ref <311>: PATENT FILING DATE: 2008-04-03
  ref <312>: PUBLICATION DATE: 2008-10-16
  ref <313>: RELEVANT RESIDUES IN SEQ ID NO: (1)..(36)
  ref <302>: TITLE: MULTIZYMES AND THEIR USE IN MAKING POLYUNSATURATED FATTY ACIDS
  ref <310>: PATENT DOCUMENT NUMBER: US-2008-0254191-A1
  ref <311>: PATENT FILING DATE: 2008-04-03
  ref <312>: PUBLICATION DATE: 2008-10-16
  ref <313>: RELEVANT RESIDUES IN SEQ ID NO: (1)..(36)
PGGPGKPSEIASLPPPIRPVGNPPAAYYDALATGRT

SEQ ID NO: 11 - DNA, 2112 bp, Artificial Sequence
  Multizyme: EgD9ES/EgD8M gene fusion
  CDS (1)..(2112): Multizyme: EgD9ES/EgD8M gene fusion
  ref <302>: TITLE: MULTIZYMES AND THEIR USE IN MAKING POLYUNSATURATED FATTY ACIDS
  ref <310>: PATENT DOCUMENT NUMBER: US-2008-0254191-A1
  ref <311>: PATENT FILING DATE: 2008-04-03
  ref <312>: PUBLICATION DATE: 2008-10-16
  ref <313>: RELEVANT RESIDUES IN SEQ ID NO: (1)..(2112)
  ref <302>: TITLE: MULTIZYMES AND THEIR USE IN MAKING POLYUNSATURATED FATTY ACIDS
  ref <310>: PATENT DOCUMENT NUMBER: WO 2008/124048
  ref <311>: PATENT FILING DATE: 2008-04-03
  ref <312>: PUBLICATION DATE: 2008-10-16
  ref <313>: RELEVANT RESIDUES IN SEQ ID NO: (1)..(2112)
atggaggtcgtgaacgaaatcgtctccattggccaggaggttcttcccaaggtcgactatgctcagctctggtctgatgcctcgcactgcgaggtgctgtacctctccatcgccttcgtcatcctgaagttcacccttggtcctctcggacccaagggtcagtctcgaatgaagtttgtgttcaccaactacaacctgctcatgtccatctactcgctgggctccttcctctctatggcctacgccatgtacaccattggtgtcatgtccgacaactgcgagaaggctttcgacaacaatgtcttccgaatcaccactcagctgttctacctcagcaagttcctcgagtacattgactccttctatctgcccctcatgggcaagcctctgacctggttgcagttctttcaccatctcggagctcctatggacatgtggctgttctacaactaccgaaacgaagccgtttggatctttgtgctgctcaacggcttcattcactggatcatgtacggctactattggacccgactgatcaagctcaagttccctatgcccaagtccctgattacttctatgcagatcattcagttcaacgttggcttctacatcgtctggaagtaccggaacattccctgctaccgacaagatggaatgagaatgtttggctggtttttcaactacttctacgttggtactgtcctgtgtctgttcctcaacttctacgtgcagacctacatcgtccgaaagcacaagggagccaaaaagattcagggcgccggtcccgctcgacctgccggacttcctcccgctacctactacgactctctggccgtcatgggatccgtgaaggcttctcgacaggctctgcccctcgtcatcgacggaaaggtgtacgacgtctccgcttgggtgaacttccaccctggtggagctgaaatcattgagaactaccagggacgagatgctactgacgccttcatggttatgcactctcaggaagccttcgacaagctcaagcgaatgcccaagatcaaccaggcttccgagctgcctccccaggctgccgtcaacgaagctcaggaggatttccgaaagctccgagaagagctgatcgccactggcatgtttgacgcctctcccctctggtactcgtacaagatcttgaccaccctgggtcttggcgtgcttgccttcttcatgctggtccagtaccacctgtacttcattggtgctctcgtgctcggtatgcactaccagcaaatgggatggctgtctcatgacatctgccaccaccagaccttcaagaaccgaaactggaataacgtcctgggtctggtctttggcaacggactccagggcttctccgtgacctggtggaaggacagacacaacgcccatcattctgctaccaacgttcagggtcacgatcccgacattgataacctgcctctgctcgcctggtccgaggacgatgtcactcgagcttctcccatctcccgaaagctcattcagttccaacagtactatttcctggtcatctgtattctcctgcgattcatctggtgtttccagtctgtgctgaccgttcgatccctcaaggaccgagacaaccagttctaccgatctcagtacaagaaagaggccattggactcgctctgcactggactctcaagaccctgttccacctcttctttatgccctccatcctgacctcgatgctggtgttctttgtttccgagctcgtcggtggcttcggaattgccatcgtggtcttcatgaaccactaccctctggagaagatcggtgattccgtctgggacggacatggcttctctgtgggtcagatccatgagaccatgaacattcgacgaggcatcattactgactggttctttggaggcctgaactaccagatcgagcaccatctctggcccaccctgcctcgacacaacctcactgccgtttcctaccaggtggaacagctgtgccagaagcacaacctcccctaccgaaaccctctgccccatgaaggtctcgtcatcctgctccgatacctgtcccagttcgctcgaatggccgagaagcagcccggtgccaaggctcagtaa

SEQ ID NO: 12 - protein, 703 aa, Artificial Sequence
  Synthetic Construct
MEVVNEIVSIGQEVLPKVDYAQLWSDASHCEVLYLSIAFVILKFTLGPLGPKGQSRMKFVFTNYNLLMSIYSLGSFLSMAYAMYTIGVMSDNCEKAFDNNVFRITTQLFYLSKFLEYIDSFYLPLMGKPLTWLQFFHHLGAPMDMWLFYNYRNEAVWIFVLLNGFIHWIMYGYYWTRLIKLKFPMPKSLITSMQIIQFNVGFYIVWKYRNIPCYRQDGMRMFGWFFNYFYVGTVLCLFLNFYVQTYIVRKHKGAKKIQGAGPARPAGLPPATYYDSLAVMGSVKASRQALPLVIDGKVYDVSAWVNFHPGGAEIIENYQGRDATDAFMVMHSQEAFDKLKRMPKINQASELPPQAAVNEAQEDFRKLREELIATGMFDASPLWYSYKILTTLGLGVLAFFMLVQYHLYFIGALVLGMHYQQMGWLSHDICHHQTFKNRNWNNVLGLVFGNGLQGFSVTWWKDRHNAHHSATNVQGHDPDIDNLPLLAWSEDDVTRASPISRKLIQFQQYYFLVICILLRFIWCFQSVLTVRSLKDRDNQFYRSQYKKEAIGLALHWTLKTLFHLFFMPSILTSMLVFFVSELVGGFGIAIVVFMNHYPLEKIGDSVWDGHGFSVGQIHETMNIRRGIITDWFFGGLNYQIEHHLWPTLPRHNLTAVSYQVEQLCQKHNLPYRNPLPHEGLVILLRYLSQFARMAEKQPGAKAQ

SEQ ID NO: 13 - DNA, 2109 bp, Artificial Sequence
  Multizyme: EaD9ES/EaD8S gene fusion
  CDS (1)..(2109): Multizyme: EaD9ES/EaD8S gene fusion
  ref <302>: TITLE: MULTIZYMES AND THEIR USE IN MAKING POLYUNSATURATED FATTY ACIDS
  ref <310>: PATENT DOCUMENT NUMBER: WO 2008/124048
  ref <311>: PATENT FILING DATE: 2008-04-03
  ref <312>: PUBLICATION DATE: 2008-10-16
  ref <313>: RELEVANT RESIDUES IN SEQ ID NO: (1)..(2109)
  ref <302>: TITLE: MULTIZYMES AND THEIR USE IN MAKING POLYUNSATURATED FATTY ACIDS
  ref <310>: PATENT DOCUMENT NUMBER: US-2008-0254191-A1
  ref <311>: PATENT FILING DATE: 2008-04-03
  ref <312>: PUBLICATION DATE: 2008-10-16
  ref <313>: RELEVANT RESIDUES IN SEQ ID NO: (1)..(2109)
atggaggctgccaaggagctggtctccatcgtccaggaggaacttcccaaggtggactacgcccagctctggcaggacgcctcctcttgcgaggttctgtacctctcggtcgctttcgtggccatcaagttcatgcttcgacctctggacctcaagcgacaagccaccctcaaaaagctgttcaccgcatacaactttctcatgtccatctactcgttcggctccttcctggcgatggcctacgctctctctgtcactggtattctttccggcgattgtgagactgccttcaacaatgacgtgttccgaatcaccactcagctgttctacctcagcaagttcgtcgagtacatcgactccttctaccttcccctcatggacaagcccttgtcgtttctgcagttctttcaccatctcggagctcccatcgacatgtggctgttctacaagtatcgaaacgaaggcgtctggatctttgttctgctcaacggcttcattcactggatcatgtacggttactattggacgcgactcatcaagctgaacttccctatgcccaagaacctcattacctccatgcaaattatccagttcaacgtcggattctacatcgtctggaagtaccgaaacgtgccctgctaccggcaggacggtatgcgaatgtttgcctggatcttcaactactggtatgtcggcacggtgctgcttctgttcctcaacttctacgtccagacctacattcggaagcctcgaaagaaccgaggcaaaaaggagggcgccggtcccgctcgacctgccggacttcctcccgctacctactacgactctctggccgtcatgggatccatggtcaagcgacccgctctgcctctcaccgtggacggtgtcacctacgacgtttctgcctggctcaaccaccatcccggaggtgccgacattatcgagaactaccgaggtcgggatgctaccgacgtcttcatggttatgcactccgagaacgccgtgtccaaactcagacgaatgcccatcatggaaccttcctctcccctgactccaacacctcccaagccaaactccgacgaacctcaggaggatttccgaaagctgcgagacgagctcattgctgcaggcatgttcgatgcctctcccatgtggtacgcttacaagaccctgtcgactctcggactgggtgtccttgccgtgctgttgatgacccagtggcactggtacctggttggtgctatcgtcctcggcattcactttcaacagatgggatggctctcgcacgacatttgccatcaccagctgttcaaggaccgatccatcaacaatgccattggcctgctcttcggaaacgtgcttcagggcttttctgtcacttggtggaaggaccgacacaacgctcatcactccgccaccaacgtgcagggtcacgatcccgacatcgacaacctgcctctcctggcgtggtccaaggaggacgtcgagcgagctggcccgttttctcgacggatgatcaagtaccaacagtattacttctttttcatctgtgcccttctgcgattcatctggtgctttcagtccattcatactgccacgggtctcaaggatcgaagcaatcagtactatcgaagacagtacgagaaggagtccgtcggtctggcactccactggggtctcaaggccttgttctactatttctacatgccctcgtttctcaccggactcatggtgttctttgtctccgagctgcttggtggcttcggaattgccatcgttgtcttcatgaaccactaccctctggagaagattcaggactccgtgtgggatggtcatggcttctgtgctggacagattcacgagaccatgaacgttcagcgaggcctcgtcacagactggtttttcggtggcctcaactaccagatcgaacatcacctgtggcctactcttcccagacacaacctcaccgctgcctccatcaaagtggagcagctgtgcaagaagcacaacctgccctaccgatctcctcccatgctcgaaggtgtcggcattcttatctcctacctgggcaccttcgctcgaatggttgccaaggcagacaaggcctaa

SEQ ID NO: 14 - protein, 702 aa, Artificial Sequence
  Synthetic Construct
MEAAKELVSIVQEELPKVDYAQLWQDASSCEVLYLSVAFVAIKFMLRPLDLKRQATLKKLFTAYNFLMSIYSFGSFLAMAYALSVTGILSGDCETAFNNDVFRITTQLFYLSKFVEYIDSFYLPLMDKPLSFLQFFHHLGAPIDMWLFYKYRNEGVWIFVLLNGFIHWIMYGYYWTRLIKLNFPMPKNLITSMQIIQFNVGFYIVWKYRNVPCYRQDGMRMFAWIFNYWYVGTVLLLFLNFYVQTYIRKPRKNRGKKEGAGPARPAGLPPATYYDSLAVMGSMVKRPALPLTVDGVTYDVSAWLNHHPGGADIIENYRGRDATDVFMVMHSENAVSKLRRMPIMEPSSPLTPTPPKPNSDEPQEDFRKLRDELIAAGMFDASPMWYAYKTLSTLGLGVLAVLLMTQWHWYLVGAIVLGIHFQQMGWLSHDICHHQLFKDRSINNAIGLLFGNVLQGFSVTWWKDRHNAHHSATNVQGHDPDIDNLPLLAWSKEDVERAGPFSRRMIKYQQYYFFFICALLRFIWCFQSIHTATGLKDRSNQYYRRQYEKESVGLALHWGLKALFYYFYMPSFLTGLMVFFVSELLGGFGIAIVVFMNHYPLEKIQDSVWDGHGFCAGQIHETMNVQRGLVTDWFFGGLNYQIEHHLWPTLPRHNLTAASIKVEQLCKKHNLPYRSPPMLEGVGILISYLGTFARMVAKADKA

SEQ ID NO: 15 - DNA, 2127 bp, Artificial Sequence
  Multizyme: E389D9eS/EgD8M gene fusion
  CDS (1)..(2127): Multizyme: E389D9eS/EgD8M gene fusion
  ref <302>: TITLE: MULTIZYMES AND THEIR USE IN MAKING POLYUNSATURATED FATTY ACIDS
  ref <310>: PATENT DOCUMENT NUMBER: US-2008-0254191-A1
  ref <311>: PATENT FILING DATE: 2008-04-03
  ref <312>: PUBLICATION DATE: 2008-10-16
  ref <313>: RELEVANT RESIDUES IN SEQ ID NO: (1)..(2127)
  ref <302>: TITLE: MULTIZYMES AND THEIR USE IN MAKING POLYUNSATURATED FATTY ACIDS
  ref <310>: PATENT DOCUMENT NUMBER: WO 2008/124048
  ref <311>: PATENT FILING DATE: 2008-04-03
  ref <312>: PUBLICATION DATE: 2008-10-16
  ref <313>: RELEVANT RESIDUES IN SEQ ID NO: (1)..(2127)
atggctgccgtcatcgaggtggccaacgagttcgtcgctatcactgccgagacccttcccaaggtggactatcagcgactctggcgagacatctactcctgcgagctcctgtacttctccattgctttcgtcatcctcaagtttacccttggcgagctctcggattctggcaaaaagattctgcgagtgctgttcaagtggtacaacctcttcatgtccgtcttttcgctggtgtccttcctctgtatgggttacgccatctacaccgttggactgtactccaacgaatgcgacagagctttcgacaacagcttgttccgatttgccaccaaggtcttctactattccaagtttctggagtacatcgactctttctaccttcccctcatggccaagcctctgtcctttctgcagttctttcatcacttgggagctcctatggacatgtggctcttcgtgcagtactctggcgaatccatttggatctttgtgttcctgaacggattcattcactttgtcatgtacggctactattggacacggctgatgaagttcaactttcccatgcccaagcagctcattaccgcaatgcagatcacccagttcaacgttggcttctacctcgtgtggtggtacaaggacattccctgttaccgaaaggatcccatgcgaatgctggcctggatcttcaactactggtacgtcggtaccgttcttctgctcttcatcaacttctttgtcaagtcctacgtgtttcccaagcctaagactgccgacaaaaaggtccagggcgccggtcccgctcgacctgccggacttcctcccgctacctactacgactctctggccgtcatgggatccgtgaaggcttctcgacaggctctgcccctcgtcatcgacggaaaggtgtacgacgtctccgcttgggtgaacttccaccctggtggagctgaaatcattgagaactaccagggacgagatgctactgacgccttcatggttatgcactctcaggaagccttcgacaagctcaagcgaatgcccaagatcaaccaggcttccgagctgcctccccaggctgccgtcaacgaagctcaggaggatttccgaaagctccgagaagagctgatcgccactggcatgtttgacgcctctcccctctggtactcgtacaagatcttgaccaccctgggtcttggcgtgcttgccttcttcatgctggtccagtaccacctgtacttcattggtgctctcgtgctcggtatgcactaccagcaaatgggatggctgtctcatgacatctgccaccaccagaccttcaagaaccgaaactggaataacgtcctgggtctggtctttggcaacggactccagggcttctccgtgacctggtggaaggacagacacaacgcccatcattctgctaccaacgttcagggtcacgatcccgacattgataacctgcctctgctcgcctggtccgaggacgatgtcactcgagcttctcccatctcccgaaagctcattcagttccaacagtactatttcctggtcatctgtattctcctgcgattcatctggtgtttccagtctgtgctgaccgttcgatccctcaaggaccgagacaaccagttctaccgatctcagtacaagaaagaggccattggactcgctctgcactggactctcaagaccctgttccacctcttctttatgccctccatcctgacctcgatgctggtgttctttgtttccgagctcgtcggtggcttcggaattgccatcgtggtcttcatgaaccactaccctctggagaagatcggtgattccgtctgggacggacatggcttctctgtgggtcagatccatgagaccatgaacattcgacgaggcatcattactgactggttctttggaggcctgaactaccagatcgagcaccatctctggcccaccctgcctcgacacaacctcactgccgtttcctaccaggtggaacagctgtgccagaagcacaacctcccctaccgaaaccctctgccccatgaaggtctcgtcatcctgctccgatacctgtcccagttcgctcgaatggccgagaagcagcccggtgccaaggctcagtaa

SEQ ID NO: 16 - protein, 708 aa, Artificial Sequence
  Synthetic Construct
MAAVIEVANEFVAITAETLPKVDYQRLWRDIYSCELLYFSIAFVILKFTLGELSDSGKKILRVLFKWYNLFMSVFSLVSFLCMGYAIYTVGLYSNECDRAFDNSLFRFATKVFYYSKFLEYIDSFYLPLMAKPLSFLQFFHHLGAPMDMWLFVQYSGESIWIFVFLNGFIHFVMYGYYWTRLMKFNFPMPKQLITAMQITQFNVGFYLVWWYKDIPCYRKDPMRMLAWIFNYWYVGTVLLLFINFFVKSYVFPKPKTADKKVQGAGPARPAGLPPATYYDSLAVMGSVKASRQALPLVIDGKVYDVSAWVNFHPGGAEIIENYQGRDATDAFMVMHSQEAFDKLKRMPKINQASELPPQAAVNEAQEDFRKLREELIATGMFDASPLWYSYKILTTLGLGVLAFFMLVQYHLYFIGALVLGMHYQQMGWLSHDICHHQTFKNRNWNNVLGLVFGNGLQGFSVTWWKDRHNAHHSATNVQGHDPDIDNLPLLAWSEDDVTRASPISRKLIQFQQYYFLVICILLRFIWCFQSVLTVRSLKDRDNQFYRSQYKKEAIGLALHWTLKTLFHLFFMPSILTSMLVFFVSELVGGFGIAIVVFMNHYPLEKIGDSVWDGHGFSVGQIHETMNIRRGIITDWFFGGLNYQIEHHLWPTLPRHNLTAVSYQVEQLCQKHNLPYRNPLPHEGLVILLRYLSQFARMAEKQPGAKAQ

SEQ ID NO: 17 - DNA, 945 bp, Mortierella alpina
  CDS (1)..(945): LPAAT1
  ref <302>: TITLE: A MORTIERELLA ALPINA LYSOPHOSPHATIDIC ACID ACYLTRANSFERASE FOR IMPROVEMENT OF LONG CHAIN OMEGA-3 AND OMEGA-6 POLYUNSATURATED FATTY ACID BIOSYNTHESIS IN OLEAGINOUS ORGANISMS
  ref <310>: PATENT DOCUMENT NUMBER: US 7,879,591
  ref <311>: PATENT FILING DATE: 2009-06-16
  ref <312>: PUBLICATION DATE: 2011-02-01
  ref <313>: RELEVANT RESIDUES IN SEQ ID NO: (1)..(945)
atgtccataggttcttccaatcctgtcctgctggcagcgatccccttcgtctacctcttcgtcctccctcgtgtcctcgccttcctccctcaaaaggcccagttcctcgcaaaatgcatcgtggtcttgatcgccacccttatcatgtccgtcgcaggctgcttcatttccatcgtctgtgcgctcctcgataaacgctatgtgatcaactacgtcgtctcaagactcttctcattcctcgctgcaagaccctgcggtgtcacctacaagatcgtcggcgaggaacatctggacaagtaccccgccattgtcgtctgcaaccaccagagctccatggacatgatggtcctgggacgcgtcttcccaaagcactgtgtcgtcatggcaaagaaggaacttctttactttccgttcctgggcatgtttatgaagctgagtaacgccatcttcattgaccgcaagaaccacaagaaggcgatcgagtccaccacccaagctgtcgccgacatgaagaagcacaactctggaatctggattttccccgaaggaacacgttcccgcttggacaaggccgatctcttgcccttcaagaagggagccttccacctcgccattcaagcccaactcccgatcctccccatcatctcgcaaggatactcacacatctacgattcgtcaaaacgctacttccccggtggagagctcgagatcagagtcctggaacctatccccaccacgggattgaccacagacgatgtgaacgacctgatggacaagactcgcaacctgatgctgaagcacctcaaggagatggattctcaatactcctcctccaccgctgaaaacggatcgacccatattgacgccgatatcgcaaagtcaactgccacatcgatcggaaacacggacgatgctatcacaaagaggaggacaccaaaagagtag

SEQ ID NO: 18 - protein, 314 aa, Mortierella alpina
MSIGSSNPVLLAAIPFVYLFVLPRVLAFLPQKAQFLAKCIVVLIATLIMSVAGCFISIVCALLDKRYVINYVVSRLFSFLAARPCGVTYKIVGEEHLDKYPAIVVCNHQSSMDMMVLGRVFPKHCVVMAKKELLYFPFLGMFMKLSNAIFIDRKNHKKAIESTTQAVADMKKHNSGIWIFPEGTRSRLDKADLLPFKKGAFHLAIQAQLPILPIISQGYSHIYDSSKRYFPGGELEIRVLEPIPTTGLTTDDVNDLMDKTRNLMLKHLKEMDSQYSSSTAENGSTHIDADIAKSTATSIGNTDDAITKRRTPKE

SEQ ID NO: 19 - DNA, 955 bp, Mortierella alpina
  CDS (3)..(947): synthetic LPAAT1 (codon-optimized for Yarrowia lipolytica)
  ref <302>: TITLE: A MORTIERELLA ALPINA LYSOPHOSPHATIDIC ACID ACYLTRANSFERASE FOR IMPROVEMENT OF LONG CHAIN OMEGA-3 AND OMEGA-6 POLYUNSATURATED FATTY ACID BIOSYNTHESIS IN OLEAGINOUS ORGANISMS
  ref <310>: PATENT DOCUMENT NUMBER: US 7,879,591
  ref <311>: PATENT FILING DATE: 2009-06-16
  ref <312>: PUBLICATION DATE: 2011-02-01
  ref <313>: RELEVANT RESIDUES IN SEQ ID NO: (1)..(955)
acatgtctattggttcgtccaaccccgtgctcttggctgcgattcccttcgtctacctgtttgtcctcccacgagtcctggctttcctgcctcagaaggctcagttcctggccaaatgtattgtggtcctgattgccacgcttatcatgtccgttgcaggctgcttcatctcgatcgtgtgcgctcttctggacaagagatacgtcatcaattacgttgtgtcgcgattgttctccttccttgccgctcgaccgtgtggtgtgacctataagattgttggtgaggaacacctcgataagtaccctgctatcgtggtctgtaaccatcaatcctctatggatatgatggttttgggacgagtttttccaaagcactgcgttgtcatggcgaagaaggaactcctgtactttccctttttgggaatgtttatgaaactgagcaacgctatcttcatcgaccggaagaaccacaagaaagccatcgagtctaccacccaagccgtggcggacatgaagaagcacaactctggaatctggattttcccagagggcacccggtctagactggacaaggcagacctgctgcccttcaagaaaggtgcctttcatcttgcaattcaggcccagctccctattctccccattatctcgcagggctattcccatatctacgactcttcgaagcggtacttccccggtggagagctcgagatcagagtcctggagcccattcctacaactggcctcactactgatgatgtgaacgacctgatggacaagacacgaaaccttatgctcaagcacttgaaggagatggattcccagtattcgtcgagcactgctgaaaatggatccacgcacatcgacgccgatattgccaagtctacagccaccagcattggcaacactgacgacgcaattacaaaacgtcgtacccctaaggaataagcggccgc

SEQ ID NO: 20 - protein, 314 aa, Mortierella alpina; identical to SEQ ID NO: 18

SEQ ID NO: 21 - DNA, 849 bp, Yarrowia lipolytica
  CDS (1)..(849)
  ref <302>: TITLE: A MORTIERELLA ALPINA LYSOPHOSPHATIDIC ACID ACYLTRANSFERASE HOMOLOG FOR ALTERATION OF POLYUNSATURATED FATTY ACIDS AND OIL CONTENT IN OLEAGINOUS ORGANISMS
  ref <310>: PATENT DOCUMENT NUMBER: US7189559
  ref <311>: PATENT FILING DATE: 2005-10-14
  ref <312>: PUBLICATION DATE: 2007-03-13
  ref <313>: RELEVANT RESIDUES IN SEQ ID NO: (1)..(849)
atgtccgttgcatccaagctcgtcttctacgtccgcgccgccatcgccgtggtcatctttgccgcctgtgccacctacggcgtgctggcgtccaccattctcaccgccatcggcaagcagggcctggcccaatggaccgttgccagagccttctactactcggtgcgcatcttcctgggtatcagcatcaagctgcgtagccggcaggtgaccggaaccgccggtctggatgcctccaagatccaggtcgccaacaccaccaagcccattgacgacatcaccaaacacctgccccgaccatgcattctgatttccaaccaccagaacgaaatggacattctggtgctcggtcgcatcttcccccagtactgctccgtcaccgccaaaaaggccctcaagtggtaccctctgctgggccagttcatggcgctgtccggcaccatcttcctggaccgaaaggaccgaaccaagtccgtgcagaccctcggcggcgccgtcaagaccatccagagcggcaacggaggcaagggccagagcgtcttcatgttccccgagggaacccgatcctactccaaggacgtcggcatcatgcccttcaagaagggctgtttccacctggcggtccagtcgggcgctcccattgtccccgtggtggtccagaacacctcccgaatgttttctttcggccgaggcaagctggacgccggagagatccttgtcgacgtcctgagccccattgagaccaagggtctggacgccagcaacgtcgacgctctcatggccaccacttataaggccatgtgcgagactgccgaccagattggctacgctggccagaagactcagtag

SEQ ID NO: 22 - protein, 282 aa, Yarrowia lipolytica
MSVASKLVFYVRAAIAVVIFAACATYGVLASTILTAIGKQGLAQWTVARAFYYSVRIFLGISIKLRSRQVTGTAGLDASKIQVANTTKPIDDITKHLPRPCILISNHQNEMDILVLGRIFPQYCSVTAKKALKWYPLLGQFMALSGTIFLDRKDRTKSVQTLGGAVKTIQSGNGGKGQSVFMFPEGTRSYSKDVGIMPFKKGCFHLAVQSGAPIVPVVVQNTSRMFSFGRGKLDAGEILVDVLSPIETKGLDASNVDALMATTYKAMCETADQIGYAGQKTQ

SEQ ID NO: 23 - protein, 303 aa, Saccharomyces cerevisiae
  MISC_FEATURE (1)..(303): Slc1p; GenBank Accession No.  NP_010231
MSVIGRFLYYLRSVLVVLALAGCGFYGVIASILCTLIGKQHLAQWITARCFYHVMKLMLGLDVKVVGEENLAKKPYIMIANHQSTLDIFMLGRIFPPGCTVTAKKSLKYVPFLGWFMALSGTYFLDRSKRQEAIDTLNKGLENVKKNKRALWVFPEGTRSYTSELTMLPFKKGAFHLAQQGKIPIVPVVVSNTSTLVSPKYGVFNRGCMIVRILKPISTENLTKDKIGEFAEKVRDQMVDTLKEIGYSPAINDTTLPPQAIEYAALQHDKKVNKKIKNEPVPSVSISNDVNTHNEGSSVKKMH

SEQ ID NO: 24 - DNA, 926 bp, Saccharomyces cerevisiae
  CDS (4)..(915)
aacatgtctgttattggacgatttctttactacctgagatcggtgctcgtcgttttggccctcgctggatgtggcttctatggcgtgattgcctctatcctgtgtactctcatcggcaagcagcatctcgcgcaatggattaccgcccgatgcttttaccacgtgatgaaactgatgctgggattggacgtcaaagtcgtgggtgaagagaacctggctaagaagccctatatcatgatcgctaaccaccagtccaccctcgatatctttatgctcggcagaatcttccctcccggatgcaccgttaccgcaaagaagagccttaagtacgtccccttcctgggctggtttatggcgctttccggtacatacttcctcgaccgttccaagcggcaagaggctattgataccctgaacaaaggactggagaacgtcaaaaagaataagcgagccctctgggtttttcccgaaggtacccggtcttacacgtcggagcttaccatgctgccgttcaagaagggcgcctttcatttggcccagcagggaaagatccctatcgtcccagtggttgtgtctaacactagcacgctcgtcagccctaagtacggtgtgttcaaccgaggctgtatgattgtccgaattctgaagcccatctcgactgagaacctgacaaaagataagattggcgagttcgctgagaaagtgcgagatcagatggttgacacactgaaggaaatcggttattcccccgcaatcaacgacaccacccttcctccgcaggcaattgagtacgccgcattgcagcatgacaagaaggtgaacaaaaagattaagaacgaacctgttccatcggtgtccatttctaatgatgtgaatactcacaacgaaggatcgtctgtcaagaagatgcactaggcggccgcatg

SEQ ID NO: 25 - protein, 303 aa, Saccharomyces cerevisiae; identical to SEQ ID NO: 23

SEQ ID NO: 26 - protein, 7 aa, Artificial Sequence
  1-acyl-sn-glycerol-3-phosphate acyltransferase motif
  misc_feature (3)..(6): Xaa can be any naturally occurring amino acid
NHXXXXD

SEQ ID NO: 27 - protein, 4 aa, Artificial Sequence
  1-acyl-sn-glycerol-3-phosphate acyltransferase motif
EGTR

SEQ ID NO: 28 - DNA, 1947 bp, Yarrowia lipolytica
  CDS (1)..(1947): phospholipid:diacylglycerol acyltransferase
  ref <302>: TITLE: ACYLTRANSFERASES FOR ALTERATION OF POLYUNSATURATED FATTY ACIDS AND OIL CONTENT IN OLEAGINOUS YEASTS
  ref <310>: PATENT DOCUMENT NUMBER: US 7,901,928
  ref <311>: PATENT FILING DATE: 2009-03-11
  ref <312>: PUBLICATION DATE: 2011-03-08
  ref <313>: RELEVANT RESIDUES IN SEQ ID NO: (1)..(1947)
atgacacaacctgtgaatcggaaggcgactgtcgagcgggtcgagccagcagtggaggtggctgactccgagtccgaggccaagaccgacgtccacgttcaccaccatcatcaccaccacaagcgaaaatccgtcaagggcaagattctcaacttcttcacccgaagtcgacgtatcaccttcgtcctcggcgccgtggtcggtgtgatagccgcgggatactacgctgcgccaccggagctcagcattgatatcgatgctcttctcggcgacttgccctcgttcgactttgacgctctatctctcgacaacttgtccatggacagtgtgtcggactttgtacaagacatgaaatcgcggtttccgaccaagattctgcaggaggcggccaagatcgagaagcaccagaaaagcgaacagaaggctgccccttttgctgtgggcaaggctatgaagagcgagggactcaacgccaagtacccggtggtgctggtgcccggcgtcatctccacgggactggagagctggtccctggagggaaccgaggagtgtcccaccgagtcgcacttcagaaagcgaatgtggggctcctggtacatgatccgagtcatgctgctggacaagtactgctggctgcagaacctgatgctggacacagagaccggtctagaccctccccatttcaagctgcgagccgcccagggatttgcctccgccgacttctttatggcaggctactggctgtggaacaagctgctcgagaacctggctgttattggatacgatacggatacaatgtctgctgcggcgtacgactggagactgtcctaccctgatttggagcaccgagacggatacttctccaagctcaaagcttcaatcgaagagactaagcgtatgacaggtgagaagacagttctgacgggccattccatgggctcccaggtcatcttctacttcatgaagtgggctgaggccgagggatatggaggaggaggtcccaactgggtcaatgaccatattgaatcctttgtcgacatttccggctccatgctgggtactcccaagaccctggttgctcttctgtctggagaaatgaaggataccgtgcagctgaacgcgatggctgtgtatggactggagcagttcttctctcgacgagagcgagccgatctgctgcgaacatggggaggaattgcttccatgattcccaagggtggtaaggctatctggggtgatcattctggagcccctgatgacgagcccggccagaatgtcacctttggcaacttcatcaagttcaaggagtccttgaccgagtactctgctaagaacctcaccatggatgaaaccgttgacttcctgtattctcagtctcccgagtggtttgtgaaccgaaccgagggtgcttactcctttggaattgccaagactcgaaagcaggttgagcagaatgagaagcgaccttctacctggagcaaccctctggaagctgctctccccaatgcccccgatctcaagatctactgcttctatggagtcggtaaggataccgagcgagcctactactaccaggatgagcccaatcccgagcagaccaacttgaacgtcagtatcgctggaaacgaccctgatggtgtgcttatgggtcagggcgatggaaccgtctcccttgtgacccataccatgtgtcaccgatggaaggacgagaattccaagttcaaccctggtaacgcccaggtcaaggttgtggagatgttgcaccagcctgatcgacttgatattcgaggcggtgctcagactgccgagcatgtggacattctggggcgttctgagttgaacgagatggttctgaaggtggctagtggaaagggaaatgagattgaagagagagtcatctccaacattgatgagtgggtgtggaagattgatctcggcagcaattag

SEQ ID NO: 29 - protein, 648 aa, Yarrowia lipolytica
MTQPVNRKATVERVEPAVEVADSESEAKTDVHVHHHHHHHKRKSVKGKILNFFTRSRRITFVLGAVVGVIAAGYYAAPPELSIDIDALLGDLPSFDFDALSLDNLSMDSVSDFVQDMKSRFPTKILQEAAKIEKHQKSEQKAAPFAVGKAMKSEGLNAKYPVVLVPGVISTGLESWSLEGTEECPTESHFRKRMWGSWYMIRVMLLDKYCWLQNLMLDTETGLDPPHFKLRAAQGFASADFFMAGYWLWNKLLENLAVIGYDTDTMSAAAYDWRLSYPDLEHRDGYFSKLKASIEETKRMTGEKTVLTGHSMGSQVIFYFMKWAEAEGYGGGGPNWVNDHIESFVDISGSMLGTPKTLVALLSGEMKDTVQLNAMAVYGLEQFFSRRERADLLRTWGGIASMIPKGGKAIWGDHSGAPDDEPGQNVTFGNFIKFKESLTEYSAKNLTMDETVDFLYSQSPEWFVNRTEGAYSFGIAKTRKQVEQNEKRPSTWSNPLEAALPNAPDLKIYCFYGVGKDTERAYYYQDEPNPEQTNLNVSIAGNDPDGVLMGQGDGTVSLVTHTMCHRWKDENSKFNPGNAQVKVVEMLHQPDRLDIRGGAQTAEHVDILGRSELNEMVLKVASGKGNEIEERVISNIDEWVWKIDLGSN

SEQ ID NO: 30 - protein, 661 aa, Saccharomyces cerevisiae
  MISC_FEATURE (1)..(661): GenBank Accession No. P40345
MGTLFRRNVQNQKSDSDENNKGGSVHNKRESRNHIHHQQGLGHKRRRGISGSAKRNERGKDFDRKRDGNGRKRWRDSRRLIFILGAFLGVLLPFSFGAYHVHNSDSDLFDNFVNFDSLKVYLDDWKDVLPQGISSFIDDIQAGNYSTSSLDDLSENFAVGKQLLRDYNIEAKHPVVMVPGVISTGIESWGVIGDDECDSSAHFRKRLWGSFYMLRTMVMDKVCWLKHVMLDPETGLDPPNFTLRAAQGFESTDYFIAGYWIWNKVFQNLGVIGYEPNKMTSAAYDWRLAYLDLERRDRYFTKLKEQIELFHQLSGEKVCLIGHSMGSQIIFYFMKWVEAEGPLYGNGGRGWVNEHIDSFINAAGTLLGAPKAVPALISGEMKDTIQLNTLAMYGLEKFFSRIERVKMLQTWGGIPSMLPKGEEVIWGDMKSSSEDALNNNTDTYGNFIRFERNTSDAFNKNLTMKDAINMTLSISPEWLQRRVHEQYSFGYSKNEEELRKNELHHKHWSNPMEVPLPEAPHMKIYCIYGVNNPTERAYVYKEEDDSSALNLTIDYESKQPVFLTEGDGTVPLVAHSMCHKWAQGASPYNPAGINVTIVEMKHQPDRFDIRGGAKSAEHVDILGSAELNDYILKIASGNGDLVEPRQLSNLSQWVSQMPFPM

SEQ ID NO: 31 - DNA, 777 bp, Euglena gracilis
  CDS (1)..(777): delta-9 elongase
  ref <302>: TITLE: DELTA-9 ELONGASES AND THEIR USE IN MAKING POLYUNSATURATED FATTY ACIDS
  ref <310>: PATENT DOCUMENT NUMBER: WO 2007/061742
  ref <311>: PATENT FILING DATE: 2006-11-16
  ref <312>: PUBLICATION DATE: 2007-05-31
  ref <313>: RELEVANT RESIDUES IN SEQ ID NO: (1)..(777)
  ref <302>: TITLE: DELTA-9 ELONGASES AND THEIR USE IN MAKING POLYUNSATURATED FATTY ACIDS
  ref <310>: PATENT DOCUMENT NUMBER: US 7,645,604
  ref <311>: PATENT FILING DATE: 2006-11-16
  ref <312>: PUBLICATION DATE: 2010-01-12
  ref <313>: RELEVANT RESIDUES IN SEQ ID NO: (1)..(777)
atggaggtggtgaatgaaatagtctcaattgggcaggaagttttacccaaagttgattatgcccaactctggagtgatgccagtcactgtgaggtgctttacttgtccatcgcatttgtcatcttgaagttcactcttggcccccttggtccaaaaggtcagtctcgtatgaagtttgttttcaccaattacaaccttctcatgtccatttattcgttgggatcattcctctcaatggcatatgccatgtacaccatcggtgttatgtctgacaactgcgagaaggcttttgacaacaacgtcttcaggatcaccacgcagttgttctatttgagcaagttcctggagtatattgactccttctatttgccactgatgggcaagcctctgacctggttgcaattcttccatcatttgggggcaccgatggatatgtggctgttctataattaccgaaatgaagctgtttggatttttgtgctgttgaatggtttcatccactggatcatgtacggttattattggaccagattgatcaagctgaagttccccatgccaaaatccctgattacatcaatgcagatcattcaattcaatgttggtttctacattgtctggaagtacaggaacattccctgttatcgccaagatgggatgaggatgtttggctggttcttcaattacttttatgttggcacagtcttgtgtttgttcttgaatttctatgtgcaaacgtatatcgtcaggaagcacaagggagccaaaaagattcagtga

SEQ ID NO: 32 - protein, 258 aa, Euglena gracilis; identical to SEQ ID NO: 3

SEQ ID NO: 33 - DNA, 774 bp, Euglena anabaena UTEX 373
  CDS (1)..(774): delta-9 elongase
  ref <302>: TITLE: DELTA-9 ELONGASES AND THEIR USE IN MAKING POLYUNSATURATED FATTY ACIDS
  ref <310>: PATENT DOCUMENT NUMBER: U.S. 7,794,701
  ref <311>: PATENT FILING DATE: 2008-04-15
  ref <312>: PUBLICATION DATE: 2010-09-14
  ref <313>: RELEVANT RESIDUES IN SEQ ID NO: (1)..(774)
  ref <302>: TITLE: DELTA-9 ELONGASES AND THEIR USE IN MAKING POLYUNSATURATED FATTY ACIDS
  ref <310>: PATENT DOCUMENT NUMBER: WO 2008/128241
  ref <311>: PATENT FILING DATE: 2008-04-16
  ref <312>: PUBLICATION DATE: 2008-10-23
  ref <313>: RELEVANT RESIDUES IN SEQ ID NO: (1)..(774)
atggaagcagccaaagaattggtttccatcgtccaagaggagctccccaaggtggactatgcccagctttggcaggatgccagcagctgtgaggtcctttacctctcggtggcattcgtggcgatcaagttcatgctgcgcccactggacctgaagcgccaggccaccttgaagaagctgttcacagcatacaacttcctcatgtcgatctattcctttggctccttcctggccatggcctatgccctatcagtaactggcatcctctccggcgactgtgagacggcgttcaacaacgatgtgttcaggatcacaactcagctgttctacctcagcaagttcgtagagtacatcgactccttctaccttccccttatggacaagccactgtcgttccttcagttcttccatcatttgggggcccccattgacatgtggctattctacaaataccgcaacgaaggagtctggatctttgtcctgttgaatgggttcattcactggatcatgtacggttactattggacgcggctcatcaagctgaacttccccatgcccaagaacctgatcacctccatgcagatcatccagttcaatgtcgggttctacatcgtctggaagtaccgcaatgtgccatgctaccgccaggatgggatgcgcatgtttgcctggatcttcaactactggtatgtcgggacggtcttgctgctgttcctcaacttttacgtgcagacgtacatccggaagccgaggaagaaccgagggaagaaggag

SEQ ID NO: 34 - protein, 258 aa, Euglena anabaena UTEX 373
MEAAKELVSIVQEELPKVDYAQLWQDASSCEVLYLSVAFVAIKFMLRPLDLKRQATLKKLFTAYNFLMSIYSFGSFLAMAYALSVTGILSGDCETAFNNDVFRITTQLFYLSKFVEYIDSFYLPLMDKPLSFLQFFHHLGAPIDMWLFYKYRNEGVWIFVLLNGFIHWIMYGYYWTRLIKLNFPMPKNLITSMQIIQFNVGFYIVWKYRNVPCYRQDGMRMFAWIFNYWYVGTVLLLFLNFYVQTYIRKPRKNRGKKE

SEQ ID NO: 35 - DNA, 774 bp, Euglena anabaena UTEX 373
  CDS (1)..(774): synthetic delta-9 elongase (codon-optimized for Yarrowia lipolytica)
  ref <302>: TITLE: DELTA-9 ELONGASES AND THEIR USE IN MAKING POLYUNSATURATED FATTY ACIDS
  ref <310>: PATENT DOCUMENT NUMBER: U.S. 7,794,701
  ref <311>: PATENT FILING DATE: 2008-04-15
  ref <312>: PUBLICATION DATE: 2010-09-14
  ref <313>: RELEVANT RESIDUES IN SEQ ID NO: (1)..(774)
  ref <302>: TITLE: DELTA-9 ELONGASES AND THEIR USE IN MAKING POLYUNSATURATED FATTY ACIDS
  ref <310>: PATENT DOCUMENT NUMBER: WO 2008/128241
  ref <311>: PATENT FILING DATE: 2008-04-16
  ref <312>: PUBLICATION DATE: 2008-10-23
  ref <313>: RELEVANT RESIDUES IN SEQ ID NO: (1)..(774)
atggaggctgccaaggagctggtctccatcgtccaggaggaacttcccaaggtggactacgcccagctctggcaggacgcctcctcttgcgaggttctgtacctctcggtcgctttcgtggccatcaagttcatgcttcgacctctggacctcaagcgacaagccaccctcaaaaagctgttcaccgcatacaactttctcatgtccatctactcgttcggctccttcctggcgatggcctacgctctctctgtcactggtattctttccggcgattgtgagactgccttcaacaatgacgtgttccgaatcaccactcagctgttctacctcagcaagttcgtcgagtacatcgactccttctaccttcccctcatggacaagcccttgtcgtttctgcagttctttcaccatctcggagctcccatcgacatgtggctgttctacaagtatcgaaacgaaggcgtctggatctttgttctgctcaacggcttcattcactggatcatgtacggttactattggacgcgactcatcaagctgaacttccctatgcccaagaacctcattacctccatgcaaattatccagttcaacgtcggattctacatcgtctggaagtaccgaaacgtgccctgctaccggcaggacggtatgcgaatgtttgcctggatcttcaactactggtatgtcggcacggtgctgcttctgttcctcaacttctacgtccagacctacattcggaagcctcgaaagaaccgaggcaaaaaggag

SEQ ID NO: 36 - protein, 258 aa, Euglena anabaena UTEX 373; identical to SEQ ID NO: 34

SEQ ID NO: 37 - DNA, 792 bp, Eutreptiella sp. CCMP389
  CDS (1)..(792): delta-9 elongase
  ref <302>: TITLE: DELTA-9 ELONGASES AND THEIR USE IN MAKING POLYUNSATURATED FATTY ACIDS
  ref <310>: PATENT DOCUMENT NUMBER: WO 2007/061742
  ref <311>: PATENT FILING DATE: 2006-11-16
  ref <312>: PUBLICATION DATE: 2007-05-31
  ref <313>: RELEVANT RESIDUES IN SEQ ID NO: (1)..(792)
  ref <302>: TITLE: DELTA-9 ELONGASES AND THEIR USE IN MAKING POLYUNSATURATED FATTY ACIDS
  ref <310>: PATENT DOCUMENT NUMBER: US 7,645,604
  ref <311>: PATENT FILING DATE: 2006-11-16
  ref <312>: PUBLICATION DATE: 2010-01-12
  ref <313>: RELEVANT RESIDUES IN SEQ ID NO: (1)..(792)
atggctgcggtgatagaggtcgccaacgagtttgtagccatcacggcagaaacgctccccaaagttgactatcaacgactatggcgagacatttacagttgtgagctactgtatttctccattgccttcgtgatcttgaagtttacgttgggcgagttgagcgacagcggaaaaaagattttgagagtgttgttcaagtggtacaatctcttcatgtccgtgttctccttggtgtctttcctttgcatgggctatgccatttataccgtgggcctatactctaacgaatgcgacagggctttcgacaactcgttgttccgctttgcaacaaaggtgttctactacagtaagtttttggagtacatcgactctttttatcttccgctcatggccaagccgctgtctttcctgcaattcttccatcacttgggagcccccatggacatgtggctctttgtccaatattctggggaatctatttggatctttgtgtttttgaatgggttcattcactttgttatgtacgggtactactggactcggctgatgaagttcaatttcccaatgcccaagcagttgattaccgcgatgcagatcacgcagttcaacgttggtttctacctcgtgtggtggtacaaagatattccctgctaccgaaaggatcccatgcgaatgttggcctggatcttcaattactggtatgttgggactgtcttgctgctgttcattaatttcttcgtcaaatcctatgtgttcccaaagccgaagactgcagataaaaaggtccaatag

SEQ ID NO: 38 - protein, 263 aa, Eutreptiella sp. CCMP389
MAAVIEVANEFVAITAETLPKVDYQRLWRDIYSCELLYFSIAFVILKFTLGELSDSGKKILRVLFKWYNLFMSVFSLVSFLCMGYAIYTVGLYSNECDRAFDNSLFRFATKVFYYSKFLEYIDSFYLPLMAKPLSFLQFFHHLGAPMDMWLFVQYSGESIWIFVFLNGFIHFVMYGYYWTRLMKFNFPMPKQLITAMQITQFNVGFYLVWWYKDIPCYRKDPMRMLAWIFNYWYVGTVLLLFINFFVKSYVFPKPKTADKKVQ

SEQ ID NO: 39 - DNA, 792 bp, Eutreptiella sp. CCMP389
  CDS (1)..(792): synthetic delta-9 elongase (codon-optimized for Yarrowia lipolytica)
  ref <302>: TITLE: DELTA-9 ELONGASES AND THEIR USE IN MAKING POLYUNSATURATED FATTY ACIDS
  ref <310>: PATENT DOCUMENT NUMBER: WO 2007/061742
  ref <311>: PATENT FILING DATE: 2006-11-16
  ref <312>: PUBLICATION DATE: 2007-05-31
  ref <313>: RELEVANT RESIDUES IN SEQ ID NO: (1)..(792)
  ref <302>: TITLE: DELTA-9 ELONGASES AND THEIR USE IN MAKING POLYUNSATURATED FATTY ACIDS
  ref <310>: PATENT DOCUMENT NUMBER: US 7,645,604
  ref <311>: PATENT FILING DATE: 2006-11-16
  ref <312>: PUBLICATION DATE: 2010-01-12
  ref <313>: RELEVANT RESIDUES IN SEQ ID NO: (1)..(792)
atggctgccgtcatcgaggtggccaacgagttcgtcgctatcactgccgagacccttcccaaggtggactatcagcgactctggcgagacatctactcctgcgagctcctgtacttctccattgctttcgtcatcctcaagtttacccttggcgagctctcggattctggcaaaaagattctgcgagtgctgttcaagtggtacaacctcttcatgtccgtcttttcgctggtgtccttcctctgtatgggttacgccatctacaccgttggactgtactccaacgaatgcgacagagctttcgacaacagcttgttccgatttgccaccaaggtcttctactattccaagtttctggagtacatcgactctttctaccttcccctcatggccaagcctctgtcctttctgcagttctttcatcacttgggagctcctatggacatgtggctcttcgtgcagtactctggcgaatccatttggatctttgtgttcctgaacggattcattcactttgtcatgtacggctactattggacacggctgatgaagttcaactttcccatgcccaagcagctcattaccgcaatgcagatcacccagttcaacgttggcttctacctcgtgtggtggtacaaggacattccctgttaccgaaaggatcccatgcgaatgctggcctggatcttcaactactggtacgtcggtaccgttcttctgctcttcatcaacttctttgtcaagtcctacgtgtttcccaagcctaagactgccgacaaaaaggtccagtag

SEQ ID NO: 40 - protein, 263 aa, Eutreptiella sp. CCMP389; identical to SEQ ID NO: 38

SEQ ID NO: 41 - DNA, 1064 bp, Isochrysis galbana (GenBank Accession No. AF390174)
  CDS (2)..(793): delta-9 elongase (IgD9e)
gatggccctcgcaaacgacgcgggagagcgcatctgggcggctgtgaccgacccggaaatcctcattggcaccttctcgtacttgctactcaaaccgctgctccgcaattccgggctggtggatgagaagaagggcgcatacaggacgtccatgatctggtacaacgttctgctggcgctcttctctgcgctgagcttctacgtgacggcgaccgccctcggctgggactatggtacgggcgcgtggctgcgcaggcaaaccggcgacacaccgcagccgctcttccagtgcccgtccccggtttgggactcgaagctcttcacatggaccgccaaggcattctattactccaagtacgtggagtacctcgacacggcctggctggtgctcaagggcaagagggtctcctttctccaggccttccaccactttggcgcgccgtgggatgtgtacctcggcattcggctgcacaacgagggcgtatggatcttcatgtttttcaactcgttcattcacaccatcatgtacacctactacggcctcaccgccgccgggtataagttcaaggccaagccgctcatcaccgcgatgcagatctgccagttcgtgggcggcttcctgttggtctgggactacatcaacgtcccctgcttcaactcggacaaagggaagttgttcagctgggctttcaactatgcatacgtcggctcggtcttcttgctcttctgccactttttctaccaggacaacttggcaacgaagaaatcggccaaggcgggcaagcagctctaggcctcgagccggctcgcgggttcaaggagggcgacacgggggtgggacgtttgcatggagatggattgtggatgtccttacgccttactcatcaatgtcctcccatctctcccctctagaccttctactagccatctagaagggcagctcagagacggataccgttccccctccccttccttttcgtctttgctttgccattgtttgtttgtctctattttttaaactattgacgctaacgcgttacgctcgcaaaaaaaaaaaaaaaaaa

SEQ ID NO: 42 - protein, 263 aa, Isochrysis galbana (GenBank Accession No. AF390174)
MALANDAGERIWAAVTDPEILIGTFSYLLLKPLLRNSGLVDEKKGAYRTSMIWYNVLLALFSALSFYVTATALGWDYGTGAWLRRQTGDTPQPLFQCPSPVWDSKLFTWTAKAFYYSKYVEYLDTAWLVLKGKRVSFLQAFHHFGAPWDVYLGIRLHNEGVWIFMFFNSFIHTIMYTYYGLTAAGYKFKAKPLITAMQICQFVGGFLLVWDYINVPCFNSDKGKLFSWAFNYAYVGSVFLLFCHFFYQDNLATKKSAKAGKQL

SEQ ID NO: 43 - DNA, 777 bp, Euglena gracilis
  CDS (1)..(777): mutant delta-9 elongase "EgD9eS-L35G"
atggaggtcgtgaacgaaatcgtctccattggccaggaggttcttcccaaggtcgactatgctcagctctggtctgatgcctcgcactgcgaggtgctgtacgggtccatcgccttcgtcatcctgaagttcacccttggtcctctcggacccaagggtcagtctcgaatgaagtttgtgttcaccaactacaacctgctcatgtccatctactcgctgggctccttcctctctatggcctacgccatgtacaccattggtgtcatgtccgacaactgcgagaaggctttcgacaacaatgtcttccgaatcaccactcagctgttctacctcagcaagttcctcgagtacattgactccttctatctgcccctcatgggcaagcctctgacctggttgcagttctttcaccatctcggagctcctatggacatgtggctgttctacaactaccgaaacgaagccgtttggatctttgtgctgctcaacggcttcattcactggatcatgtacggctactattggacccgactgatcaagctcaagttccctatgcccaagtccctgattacttctatgcagatcattcagttcaacgttggcttctacatcgtctggaagtaccggaacattccctgctaccgacaagatggaatgagaatgtttggctggtttttcaactacttctacgttggtactgtcctgtgtctgttcctcaacttctacgtgcagacctacatcgtccgaaagcacaagggagccaaaaagattcagtga

SEQ ID NO: 44 - protein, 258 aa, Euglena gracilis
MEVVNEIVSIGQEVLPKVDYAQLWSDASHCEVLYGSIAFVILKFTLGPLGPKGQSRMKFVFTNYNLLMSIYSLGSFLSMAYAMYTIGVMSDNCEKAFDNNVFRITTQLFYLSKFLEYIDSFYLPLMGKPLTWLQFFHHLGAPMDMWLFYNYRNEAVWIFVLLNGFIHWIMYGYYWTRLIKLKFPMPKSLITSMQIIQFNVGFYIVWKYRNIPCYRQDGMRMFGWFFNYFYVGTVLCLFLNFYVQTYIVRKHKGAKKIQ

SEQ ID NO: 45 - DNA, 1101 bp, Yarrowia lipolytica
  CDS (1)..(1101): cholinephosphate cytidylyltransferase; GenBank Accession No. XM_502978
atggccaaaagcaaacgacggtcggaggctgtggaagagcacgtgaccggctcggacgagggcttgaccgatacttcgggtcacgtgagccctgccgccaagaagcagaagaactcggagattcatttcaccacccaggctgcccagcagttggatcgggagcgcaaggaggagtatctggactcgctgatcgacaacaaggactatctcaagtaccgtcctcgaggctggaagctcaacaacccgcctaccgaccgacctgtgcgaatctacgccgatggagtgtttgatttgttccatctgggacacatgcgtcagctggagcagtccaagaaggccttccccaacgcagtgttgattgtgggcattcccagcgacaaggagacccacaagcggaagggattgaccgtgctgagtgacgtccagcggtacgagacggtgcgacactgcaagtgggtggacgaggtggtggaggatgctccctggtgtgtcaccatggactttctggaaaaacacaaaatcgactacgtggcccatgacgatctgccctacgcttccggcaacgacgatgatatctacaagcccatcaaggagaagggcatgtttctggccacccagcgaaccgagggcatttccacctcggacatcatcaccaagattatccgagactacgacaagtatttaatgcgaaactttgcccggggtgctaaccgaaaggatctcaacgtctcgtggctcaagaagaacgagctggacttcaagcgtcatgtggccgagttccgaaactcgttcaagcgaaagaaggtcggtaaggatctctacggcgagattcgcggtctgctgcagaatgtgctcatttggaacggcgacaactccggcacttccactccccagcgaaagacgctgcagaccaacgccaagaagatgtacatgaacgtgctcaagactctgcaggctcctgacgctgttgacgtggactcctcggagaacgtgtctgagaacgtcactgatgaggaggaggaagacgacgacgaggttgatgaggacgaagaagccgacgacgacgacgaagacgacgaagacgaggaagacgacgagtag

SEQ ID NO: 46 - protein, 366 aa, Yarrowia lipolytica
MAKSKRRSEAVEEHVTGSDEGLTDTSGHVSPAAKKQKNSEIHFTTQAAQQLDRERKEEYLDSLIDNKDYLKYRPRGWKLNNPPTDRPVRIYADGVFDLFHLGHMRQLEQSKKAFPNAVLIVGIPSDKETHKRKGLTVLSDVQRYETVRHCKWVDEVVEDAPWCVTMDFLEKHKIDYVAHDDLPYASGNDDDIYKPIKEKGMFLATQRTEGISTSDIITKIIRDYDKYLMRNFARGANRKDLNVSWLKKNELDFKRHVAEFRNSFKRKKVGKDLYGEIRGLLQNVLIWNGDNSGTSTPQRKTLQTNAKKMYMNVLKTLQAPDAVDVDSSENVSENVTDEEEEDDDEVDEDEEADDDDEDDEDEEDDE

SEQ ID NO: 47 - DNA, 1185 bp, Yarrowia lipolytica
  CDS (1)..(1185): diacylglycerol cholinephosphotransferase (YlCPT1)
  ref <302>: TITLE: HIGH EICOSAPENTAENOIC ACID PRODUCING STRAINS OF
  ref <310>: PATENT DOCUMENT NUMBER: WO 2006/052870
  ref <311>: PATENT FILING DATE: 2005-11-03
  ref <312>: PUBLICATION DATE: 2006-05-18
  ref <313>: RELEVANT RESIDUES IN SEQ ID NO: (1)..(1185)
  ref <302>: TITLE: HIGH EICOSAPENTAENOIC ACID PRODUCING STRAINS OF
  ref <310>: PATENT DOCUMENT NUMBER: US 2006-0115881-A1
  ref <311>: PATENT FILING DATE: 2005-11-02
  ref <312>: PUBLICATION DATE: 2006-06-01
  ref <313>: RELEVANT RESIDUES IN SEQ ID NO: (1)..(1185)
atgggcgtattcattaaacaggagcagcttccggctctcaagaagtacaagtactccgccgaggatcactcgttcatctccaacaacattctgcgccccttctggcgacagtttgtcaaaatcttccctctgtggatggcccccaacatggtgactctgttgggcttcttctttgtcattgtgaacttcatcaccatgctcattgttgatcccacccacgaccgcgagcctcccagatgggtctacctcacctacgctctgggtctgttcctttaccagacatttgatgcctgtgacggatcccatgcccgacgaactggccagagtggaccccttggagagctgtttgaccactgtgtcgacgccatgaatacctctctgattctcacggtggtggtgtccaccacccatatgggatataacatgaagctgctgattgtgcagattgccgctctcggaaacttctacctgtcgacctgggagacctaccataccggaactctgtacctttctggcttctctggtcctgttgaaggtatcttgattctggtggctcttttcgtcctcaccttcttcactggtcccaacgtgtacgctctgaccgtctacgaggctcttcccgaatccatcacttcgctgctgcctgccagcttcctggacgtcaccatcacccagatctacattggattcggagtgctgggcatggtgttcaacatctacggcgcctgcggaaacgtgatcaagtactacaacaacaagggcaagagcgctctccccgccattctcggaatcgccccctttggcatcttctacgtcggcgtctttgcctgggcccatgttgctcctctgcttctctccaagtacgccatcgtctatctgtttgccattggggctgcctttgccatgcaagtcggccagatgattcttgcccatctcgtgcttgctcccttcccccactggaacgtgctgctcttcttcccctttgtgggactggcagtgcactacattgcacccgtgtttggctgggacgccgatatcgtgtcggttaacactctcttcacctgttttggcgccaccctctccatttacgccttctttgtgcttgagatcatcgacgagatcaccaactacctcgatatctggtgtctgcgaatcaagtaccctcaggagaagaagactgagtaa

SEQ ID NO: 48 - protein, 394 aa, Yarrowia lipolytica
MGVFIKQEQLPALKKYKYSAEDHSFISNNILRPFWRQFVKIFPLWMAPNMVTLLGFFFVIVNFITMLIVDPTHDREPPRWVYLTYALGLFLYQTFDACDGSHARRTGQSGPLGELFDHCVDAMNTSLILTVVVSTTHMGYNMKLLIVQIAALGNFYLSTWETYHTGTLYLSGFSGPVEGILILVALFVLTFFTGPNVYALTVYEALPESITSLLPASFLDVTITQIYIGFGVLGMVFNIYGACGNVIKYYNNKGKSALPAILGIAPFGIFYVGVFAWAHVAPLLLSKYAIVYLFAIGAAFAMQVGQMILAHLVLAPFPHWNVLLFFPFVGLAVHYIAPVFGWDADIVSVNTLFTCFGATLSIYAFFVLEIIDEITNYLDIWCLRIKYPQEKKTE

SEQ ID NO: 49 - DNA, 1518 bp, Rhizobium leguminosarum bv. viciae 3841
  CDS (1)..(1518): synthetic malonyl-CoA synthetase (codon-optimized for Yarrowia lipolytica)
atggtctccaaccacctgttcgacgccatgcgagctgccgctcccggagacgcacctttcattcgaatcgacaacgctcggacctggacttacgatgacgccattgctctttccggtcgaatcgctggagctatggacgcactcggcattcgacccggagacagagttgccgtgcaggtcgagaagtctgccgaggcgttgattctctacctggcctgtcttcgaaccggagctgtctacctgcctctcaacactgcctacaccctggccgagctcgactacttcatcggcgatgccgaaccgcgtctggtggtcgttgctcccgcagctcgaggtggcgtggagacaattgccaagcgacacggtgctatcgtcgaaaccctcgacgccgatggacgaggctccttgctggaccttgctagagatgagcctgccgactttgtcgatgcttcgcgatctgccgacgatctggctgctattctctacacttccggtacaaccggacgatcgaagggtgccatgcttactcatggcaatctgctctccaacgctctcaccttgcgagactattggagagttaccgcagacgatcgactcatccatgccttgccaatctttcacactcatggtctgttcgttgctacgaacgtcacactgcttgcaggagcctcgatgtttctgctctccaagttcgatgccgacgaggtcgtttctctcatgccacaggccaccatgcttatgggcgtgcccacattctacgttcgattgctgcagagtcctcgactcgagaagggtgctgtggccagcatcagactgttcatttctggatcagctcccttgcttgccgaaacccacgccgagtttcatgctcgtactggtcacgccattctcgagcgatacggcatgacggaaaccaacatgaatacttccaacccctacgagggcaagcgtattgccggaaccgttggttttcctctgcccgacgtcactgtgcgagtcaccgatcccgccaccggtctcgttcttccacctgaagagactggcatgatcgagatcaagggacccaacgtcttcaagggctattggcgaatgcccgaaaagaccgctgccgagtttaccgcagacggtttctttatctctggagatctcggcaagatcgaccgagaaggttacgttcacattgtgggacgaggcaaggacctggtcatttccggtggctacaacatctatcccaaagaggtcgaaggcgagatcgaccagatcgagggtgtggtcgagtctgctgtcattggtgttcctcatcccgatttcggagaaggtgtcaccgctgttgtcgtgtgcaaacctggtgccgttctcgacgaaaagaccatcgtgtctgctctgcaggaccgtcttgcccgatacaagcaacccaagcggattatctttgccgacgatctgcctcgaaacactatgggaaaggttcagaagaacattcttcgacagcaatacgccgatctctacaccagacgataa

SEQ ID NO: 50 - protein, 505 aa, Rhizobium leguminosarum bv. viciae 3841
MVSNHLFDAMRAAAPGDAPFIRIDNARTWTYDDAIALSGRIAGAMDALGIRPGDRVAVQVEKSAEALILYLACLRTGAVYLPLNTAYTLAELDYFIGDAEPRLVVVAPAARGGVETIAKRHGAIVETLDADGRGSLLDLARDEPADFVDASRSADDLAAILYTSGTTGRSKGAMLTHGNLLSNALTLRDYWRVTADDRLIHALPIFHTHGLFVATNVTLLAGASMFLLSKFDADEVVSLMPQATMLMGVPTFYVRLLQSPRLEKGAVASIRLFISGSAPLLAETHAEFHARTGHAILERYGMTETNMNTSNPYEGKRIAGTVGFPLPDVTVRVTDPATGLVLPPEETGMIEIKGPNVFKGYWRMPEKTAAEFTADGFFISGDLGKIDREGYVHIVGRGKDLVISGGYNIYPKEVEGEIDQIEGVVESAVIGVPHPDFGEGVTAVVVCKPGAVLDEKTIVSALQDRLARYKQPKRIIFADDLPRNTMGKVQKNILRQQYADLYTRR

SEQ ID NO: 51 - protein, 1024 aa, Yarrowia lipolytica
  MISC_FEATURE (1)..(1024): YlPex1p;  GenBank Accession No. CAG82178
MTSKSDYSGKDKIELDPVFAKSIDLLPNTQVVIDIQLNPKIAHTIHLEPVTVADWEIVELHAAYLESRMINQVRAVSPNQPVTVYPSSTTSATLKVIRIEPDLGAAGFAKLSPDSEVVVAPKQRKKEEKQVKKRSGSARSTGSQKRKGGRGPHALRRAISEDFDGHLRLEVSLDVSQLPPEFHQLKNVSIKVITPPNLASPQQAASIAVEEKSEESLSQNKPPSSEPKVEVPPDIINPASEIVATLVNDTTSPTGHAKLSYALADALGIPSSVGHVIRFESASKPLSQKPGALVIHRFITKTVGAAEQKSLRLKGEKNADDGVSADDQFSLLEELKKLQMLEGPITNFQRLPPIPELLPLGGVIGLQNSEGWIQGGYLGEEPIPFVSGSEILRSESSLSPSNIESEDKRVVGLDNMLNKINEVLSRDSIGCLVYGSRGSGKSAVLNHIKKECKVSHTHTVSIACGLIAQDRVQAVREILTKAFLEASWFSPSVLFLDDIDALMPAEVEHADSSRTRQLTQLFLELALPIMKSRHVSVVASAQAKESLHMNLVTGHVFEELFHLKSPDKEARLAILSEAVKLMDQNVSFSQNDVLEIASQVDGYLPGDLWTLSERAQHEMALRQIEIGLENPSIQLADFMKALEDFVPSSLRGVKLQKSNVKWNDIGGLKETKAVLLETLEWPTKYAPIFASCPLRLRSGLLLYGYPGCGKTYLASAVAAQCGLNFISIKGPEILNKYIGASEQSVRELFERAQAAKPCILFFDEFDSIAPKRGHDSTGVTDRVVNQMLTQMDGAEGLDGVYVLAATSRPDLIDPALLRPGRLDKMLICDLPSYEDRLDILRAIVDGKMHLDGEVELEYVASRTDGFSGADLQAVMFNAYLEAIHEVVDVADDTAADTPALEDKRLEFFQTTLGDAKKDPAAVQNEVMNARAAVAEKARVTAKLEALFKGMSVGVDNDDDKPRKKAVVVIKPQHMNKSLDETSPSISKKELLKLKGIYSQFVSGRSGDMPPGTASTDVGGRATLA

SEQ ID NO: 52 - protein, 381 aa, Yarrowia lipolytica
  MISC_FEATURE (1)..(381): YlPex2p; GenBank Accession No. CAG77647
MSSVLRLFKIGAPVPNVRVHQLDASLLDAELVDLLKNQLFKGFTNFHPEFRDKYESELVLALKLILFKLTVWDHAITYGGKLQNLKFIDSRHSSKLQIQPSVIQKLGYGILVVGGGYLWSKIEGYLLARSEDDVATDGTSVRGASAARGALKVANFASLLYSAATLGNFVAFLYTGRYATVIMRLLRIRLVPSQRTSSRQVSYEFQNRQLVWNAFTEFLIFILPLLQLPKLKRRIERKLQSLNVTRVGNVEEASEGELAHLPQKTCAICFRDEEEQEGGGGASHYSTDVTNPYQADCGHVYCYVCLVTKLAQGDGDGWNCYRCAKQVQKMKPWVDVDEAAVVGAAEMHEKVDVIEHAEDNEQEEEEFDDDDEDSNFQLMKD

SEQ ID NO: 53 - protein, 431 aa, Yarrowia lipolytica
  MISC_FEATURE (1)..(431): YlPex3p; GenBank Accession No. CAG78565
MDFFRRHQKKVLALVGVALSSYLFIDYVKKKFFEIQGRLSSERTAKQNLRRRFEQNQQDADFTIMALLSSLTTPVMERYPVDQIKAELQSKRRPTDRVLALESSTSSSATAQTVPTMTSGATEEGEKSKTQLWQDLKRTTISRAFSLVYADALLIFFTRLQLNILGRRNYVNSVVALAQQGREGNAEGRVAPSFGDLADMGYFGDLSGSSSFGETIVDPDLDEQYLTFSWWLLNEGWVSLSERVEEAVRRVWDPVSPKAELGFDELSELIGRTQMLIDRPLNPSSPLNFLSQLLPPREQEEYVLAQNPSDTAAPIVGPTLRRLLDETADFIESPNAAEVIERLVHSGLSVFMDKLAVTFGATPADSGSPYPVVLPTAKVKLPSILANMARQAGGMAQGSPGVENEYIDVMNQVQELTSFSAVVYSSFDWAL

SEQ ID NO: 54 - protein, 395 aa, Yarrowia lipolytica
  MISC_FEATURE (1)..(395): YlPex3Bp; GenBank Accession No. CAG83356
MLQSLNRNKKRLAVSTGLIAVAYVVISYTTKRLIEKQEQKLEEERAKERLKQLFAQTQNEAAFHTASVLPQLCEQIMEFVAVEKIAEQLQNMRAEKRKKQNMDDDKHSVLSLGTETTASMADGQKMSKIQLWDELKIESLTRIVTLIYCVSLLNYLIRLQTNIVGRKRYQNEAGPAGATYDMSLEQCYTWLLTRGWKSVVDNVRRSVQQVFTGVNPRQNLSLDEFATLLKRVQTLVNSPPYSTTPNTFLTSLLPPRELEQLRLEKEKQSLSPNYTYGSPLKDLVFESAQHIQSPQGMSSFRAIIDQSFKVFLEKVNESQYVNPPSTGGKRIAVGALQPPIISGGPKKVKLASLLSVATRQSSVISHAQPNPYVDAINSVAEYNGLCAVIYSSFEQ

SEQ ID NO: 55 - protein, 153 aa, Yarrowia lipolytica
  MISC_FEATURE (1)..(153): YlPex4p; GenBank Accession No. CAG79130
MASQKRLIKELAAYKKDPNPCLASLTADGDSLYKWTAVMRGTEGTAYENGLWQVEINIPENYPLQPPTMFFRTKICHPNIHFETGEVCIDVLKTQWSPAWTISSACTAVSAMLSLPEPDSPLNIDAANLVRCGDESAMEGLVRYYVNKYASGN

SEQ ID NO: 56 - protein, 598 aa, Yarrowia lipolytica
  MISC_FEATURE (1)..(598): YlPex5p; GenBank Accession No. CAG78803
MSFMRGGSECSTGRNPLSQFTKHTAEDRSLQHDRVAGPSGGRVGGMRSNTGEMSQQDREMMARFGAAGPEQSSFNYEQMRHELHNMGAQGGQIPQVPSQQGAANGGQWARDFGGQQTAPGAAPQDAKNWNAEFQRGGSPAEAMQQQGPGPMQGGMGMGGMPMYGMARPMYSGMSANMAPQFQPQQANARVVELDEQNWEEQFKQMDSAVGKGKEVEEQTAETATATETVTETETTTEDKPMDIKNMDFENIWKNLQVNVLDNMDEWLEETNSPAWERDFHEYTHNRPEFADYQFEENNQFMEHPDPFKIGVELMETGGRLSEAALAFEAAVQKNTEHAEAWGRLGACQAQNEKEDPAIRALERCIKLEPGNLSALMNLSVSYTNEGYENAAYATLERWLATKYPEVVDQARNQEPRLGNEDKFQLHSRVTELFIRAAQLSPDGANIDADVQVGLGVLFYGNEEYDKAIDCFNAAIAVRPDDALLWNRLGATLANSHRSEEAIDAYYKALELRPSFVRARYNLGVSCINIGCYKEAAQYLLGALSMHKVEGVQDDVLANQSTNLYDTLKRVFLGMDRRDLVAKVGNGMDVNQFRNEFEF

SEQ ID NO: 57 - protein, 1024 aa, Yarrowia lipolytica
  MISC_FEATURE (1)..(1024): YlPex6p; GenBank Accession No. CAG82306
MPSISHKPITAKLVAAPDATKLELSSYLYQQLFSDKPAEPYVAFEAPGIKWALYPASEDRSLPQYTCKADIRHVAGSLKKFMPVVLKRVNPVTIEHAIVTVPASQYETLNTPEQVLKALEPQLDKDRPVIRQGDVLLNGCRVRLCEPVNQGKVVKGTTKLTVAKEQETIQPADEAADVAFDIAEFLDFDTSVAKTRESTNLQVAPLEGAIPTPLSDRFDDCESRGFVKSETMSKLGVFSGDIVSIKTKNGAERVLRLFAYPEPNTVKYDVVYVSPILYHNIGDKEIEVTPNGETHKSVGEALDSVLEAAEEVKLARVLGPTTTDRTFQTAYHAGLQAYFKPVKRAVRVGDLIPIPFDSILARTIGEDPEMSHIPLEALAVKPDSVAWFQVTSLNGSEDPASKQYLVDSSQTKLIEGGTTSSAVIPTSVPWREYLGLDTLPKFGSEFAYADKIRNLVQISTSALSHAKLNTSVLLHSAKRGVGKSTVLRSVAAQCGISVFEISCFGLIGDNEAQTLGTLRAKLDRAYGCSPCVVVLQHLESIAKKSDQDGKDEGIVSKLVDVLADYSGHGVLLAATSNDPDKISEAIRSRFQFEIEIGVPSEPQRRQIFSHLTKSGPGGDSIRNAPISLRSDVSVENLALQSAGLTPPDLTAIVQTTRLRAIDRLNKLTKDSDTTLDDLLTLSHGTLQLTPSDFDDAIADARQKYSDSIGAPRIPNVGWDDVGGMEGVKKDILDTIETPLKYPHWFSDGVKKRSGILFYGPPGTGKTLLAKAIATTFSLNFFSVKGPELLNMYIGESEANVRRVFQKARDAKPCVVFFDELDSVAPQRGNQGDSGGVMDRIVSQLLAELDGMSTAGGEGVFVVGATNRPDLLDEALLRPGRFDKMLYLGISDTHEKQQTIMEALTRKFRLAADVSLEAISKRCPFTFTGADFYALCSDAMLNAMTRTANEVDAKIKLLNKNREEAGEEPVSIRWWFDHEATKSDIEVEVAQQDFEKAKDELSPSVSAEELQHYLKLRQQFEGGKK

SEQ ID NO: 58 - protein, 356 aa, Yarrowia lipolytica
  MISC_FEATURE (1)..(356): YlPex7p; GenBank Accession No. CAG78389
MLGFKTQGFNGYAANYSPFFNDKIAVGTAANYGLVGNGKLFILGISPEGRMVCEGQFDTQDGIFDVAWSEQHENHVATACGDGSVKLFDIKAGAFPLVSFKEHTREVFSVNWNMANKALFCTSSWDSTIKIWTPERTNSIMTLGQPAPAQGTNASAHIGRQTAPNQAAAQECIYSAKFSPHTDSIIASAHSTGMVKVWDTRAPQPLQQQFSTQQTESGGPPEVLSLDWNKYRPTVIATGGVDRSVQVYDIRMTQPAANQPVQPLSLILGHRLPVRGVSWSPHHADLLLSCSYDMTARVWRDASTGGNYLARQRGGTEVKCMDRHTEFVIGGDWSLWGDPGWITTVGWDQMVYVWHA

SEQ ID NO: 59 - protein, 671 aa, Yarrowia lipolytica
  MISC_FEATURE (1)..(671): YlPex8p; GenBank Accession No. CAG80447
MNKYLVPPPQANRTVTNLDLLINNLRGSSTPGAAEVDTRDILQRIVFILPTIKNPLNLDLVIKEIINSPRLLPPLIDLHDYQQLTDAFRATIKRKALVTDPTISFEAWLETCFQVITRFAGPGWKKLPLLAGLILADYDISADGPTLERKPGFPSKLKHLLKREFVTTFDQCLSIDTRNRSDATKWVPVLACISIAQVYSLLGDVAINYRRFLQVGLDLIFSNYGLEMGTALARLHAESGGDATTAGGLIGKKLKEPVVALLNTFAHIASSCIVHVDIDYIDRIQNKIILVCENQAETWRILTIESPTVMHHQESVQYLKWELFTLCIIMQGIANMLLTQKMNQFMYLQLAYKQLQALHSIYFIVDQMGSQFAAYDYVFFSAIDVLLSEYAPYIKNRGTIPPNKEFVAERLAANLAGTSNVGSHLPIDRSRVLFALNYYEQLVTVCHDSCVETIIYPMARSFLYPTSDIQQLKPLVEAAHSVILAGLAVPTNAVVNAKLIPEYMGGVLPLFPGVFSWNQFVLAIQSIVNTVSPPSEVFKTNQKLFRLVLDSLMKKCRDTPVGIPVPHSVTVSQEQEDIPPTQRAVVMLALINSLPYVDIRSFELWLQETWNMIEATPMLAENAPNKELAHAEHEFLVLEMWKMISGNIDQRLNDVAIRWWYKKNARVHGTL

SEQ ID NO: 60 - protein, 377 aa, Yarrowia lipolytica
  MISC_FEATURE (1)..(377): YlPex10p; GenBank Accession No. CAG81606
MWGSSHAFAGESDLTLQLHTRSNMSDNTTIKKPIRPKPIRTERLPYAGAAEIIRANQKDHYFESVLEQHLVTFLQKWKGVRFIHQYKEELETASKFAYLGLCTLVGSKTLGEEYTNLMYTIRDRTALPGVVRRFGYVLSNTLFPYLFVRYMGKLRAKLMREYPHLVEYDEDEPVPSPETWKERVIKTFVNKFDKFTALEGFTAIHLAIFYVYGSYYQLSKRIWGMRYVFGHRLDKNEPRIGYEMLGLLIFARFATSFVQTGREYLGALLEKSVEKEAGEKEDEKEAVVPKKKSSIPFIEDTEGETEDKIDLEDPRQLKFIPEASRACTLCLSYISAPACTPCGHFFCWDCISEWVREKPECPLCRQGVREQNLLPIR

SEQ ID NO: 61 - protein, 408 aa, Yarrowia lipolytica
  MISC_FEATURE (1)..(408): YlPex12p; GenBank Accession No. CAG81532
MDYFSSLNASQLDPDVPTLFELLSAKQLEGLIAPSVRYILAFYAQRHPRYLLRIVNRYDELYALFMGLVEYYNLKTWNASFTEKFYGLKRTQILTNPALRTRQAVPDLVEAEKRLSKKKIWGSLFFLIVVPYVKEKLDARYERLKGRYLARDINEERIEIKRTGTAQQIAVFEFDYWLLKLYPIVTMGCTTATLAFHMLFLFSVTRAYSIDDFLLNIQFSRMTRYDYQMETQRDSRNAANVAHTMKSISEYPVAERVMLLLTTKAGANAMRSAALSGLSYVLPTSIFALKFLEWWYASDFARQLNQKRRGDLEDNLPVPDKVKGADKLAESVAKWKEDTSKCPLCSKELVNPTVIESGYVFCYTCIYRHLEDGDEETGGRCPVTGQKLLGCRWQDDVWQVTGLRRLMV

SEQ ID NO: 62 - protein, 412 aa, Yarrowia lipolytica
  MISC_FEATURE (1)..(412): YlPex13p; GenBank Accession No. CAG81789
MSVPRPKPWEGASGSSAATATPAATATPASTDAVSSSAGSATGAPELPSRPSAMGSTSNALSSPMGSSMNSGYGGMNSGYGGMGSSYGSGYGSSYGMGSSYGSGYGSGLGGYGSYGGMGGMGGMYGSRYGGYGSYGGMGGYGGYGGMGGGPMGQNGLAGGTQATFQLIESIVGAVGGFAQMLESTYMATQSSFFAMVSVAEQFGNLKNTLGSLLGIYAIMRWARRLVAKLSGQPVTGANGITPAGFAKFEATGGAAGPGRGPRPSYKPLLFFLTAVFGLPYLLGRLIKALAAKQEGMYDEHGNLLPGAQMGMGGPGMEGGAEIDPSKLEFCRANFDFVPENPQLELELRKGDLVAVLAKTDPMGNPSQWWRVRTRDGRSGYVPANYLEVIPRPAVEAPKKVEEIGASAVPVN

SEQ ID NO: 63 - protein, 380 aa, Yarrowia lipolytica
  MISC_FEATURE (1)..(380): YlPex14p; GenBank Accession No. CAG79323
MIPSCLSTQHMAPREDLVQSAVAFLNDPQAATAPLAKRIEFLESKDMTPEEIEEALKRAGSGSAQSHPGSVVSHGGAAPTVPASYAFQSAPPLPERDWKDVFIMATVTVGVGFGLYTVAKRYLMPLILPPTPPSLEADKEALEAEFARVQGLLDQVQQDTEEVKNSQVEVAKRVTDALKGVEETIDQLKSQTKKRDDEMKLVTAEVERIRDRLPKNIDKLKDSQEQGLADIQSELKSLKQLLSTRTAASSGPKLPPIPPPSSYLTRKASPAVPAAAPAPVTPGSPVHNVSSSSTVPADRDDFIPTPAGAVPMIPQPASMSSSSTSTVPNSAISSAPSPIQEPEPFVPEPGNSAVKKPAPKASIPAWQLAALEKEKEKEKE

SEQ ID NO: 64 - protein, 391 aa, Yarrowia lipolytica
  MISC_FEATURE (1)..(391): YlPex16p; GenBank Accession No. CAG79622
MTDKLVKVMQKKKSAPQTWLDSYDKFLVRNAASIGSIESTLRTVSYVLPGRFNDVEIATETLYAVLNVLGLYHDTIIARAVAASPNAAAVYRPSPHNRYTDWFIKNRKGYKYASRAVTFVKFGELVAEMVAKKNGGEMARWKCIIGIEGIKAGLRIYMLGSTLYQPLCTTPYPDREVTGELLETICRDEGELDIEKGLMDPQWKMPRTGRTIPEIAPTNVEGYLLTKVLRSEDVDRPYNLLSRLDNWGVVAELLSILRPLIYACLLFRQHVNKTVPASTKSKFPFLNSPWAPWIIGLVIEALSRKMMGSWLLRQRQSGKTPTALDQMEVKGRTNLLGWWLFRGEFYQAYTRPLLYSIVARLEKIPGLGLFGALISDYLYLFDRYYFTASTL

SEQ ID NO: 65 - protein, 225 aa, Yarrowia lipolytica
  MISC_FEATURE (1)..(225): YlPex17p; GenBank Accession No. CAG84025
MSAFPEPSSFEIEFAKQMNRPRTVQFKQLVAVLYIFGGTSALIYIISKTILNPLFEELTFARSEYAIHARRLMEQLNAKLSSMASYIPPVRALQGQRFVDAQTQTEDEEGEDIPNPSLGKSSHVSFGESPMQLKLAEKEKQQKLIDDSVDNLERLADSLKHAGEVSDLSALSGFKYQVEELTNYSDQLAMSGYSMMKSGLPGHETAMSETKKEIRSLKGSVLSVR

SEQ ID NO: 66 - protein, 324 aa, Yarrowia lipolytica
  MISC_FEATURE (1)..(324): YlPex19p; GenBank Accession No. AAK84827
MSHEEDLDDLDDFLDEFDEQVLSKPPGAQKDATPTTSTAPTTAEAKPDATKKSTETSGTDSKTEGADTADKNAATDSAEAGAEKVSLPNLEDQLAGLKMDDFLKDIEADPESKAQFESLLKEINNVTSATASEKAQQPKSFKETISATADRLNQSNQEMGDMPLGDDMLAGLMEQLSGAGGFGEGGEGDFGDMLGGIMRQLASKEVLYQPLKEMHDNYPKWWDEHGSKVTEEKERDRLKLQQDIVGKICAKFEDPSYSDDSEADRAVITQLMDEMQETGAPPDEIMSNVADGSIPGGLDGLGLGGLGGGKMPEMPENMPECNQQ

SEQ ID NO: 67 - protein, 417 aa, Yarrowia lipolytica
  MISC_FEATURE (1)..(417): YlPex20p; GenBank Accession No. CAG79226
MASCGPSNALQNLSKHASADRSLQHDRMAPGGAPGAQRQQFRSQTQGGQLNNEFQQFAQAGPAHNSFEQSQMGPHFGQQHFGQPHQPQMGQHAPMAHGQQSDWAQSFSQLNLGPQTGPQHTQQSNWGQDFMRQSPQSHQVQPQMANGVMGSMSGMSSFGPMYSNSQLMNSTYGLQTEHQQTHKTETKSSQDAAFEAAFGAVEESITKTSDKGKEVEKDPMEQTYRYDQADALNRQAEHISDNISREEVDIKTDENGEFASIARQIASSLEEADKSKFEKSTFMNLMRRIGNHEVTLDGDKLVNKEGEDIREEVRDELLREGASQENGFQSEAQQTAPLPVHHEAPPPEQIHPHTETGDKQLEDPMVYIEQEAARRAAESGRTVEEEKLNFYSPFEYAQKLGPQGVAKQSNWEEDYDF

SEQ ID NO: 68 - protein, 195 aa, Yarrowia lipolytica
  MISC_FEATURE (1)..(195): YlPex22p; GenBank Accession No. CAG77876
VPRCTSHPCNLTLHLPVTTMAPRKTRLPAVIGAAAAAAAVAYLVYSFVAKSNSDQDTFDSSVQSSSKSSTKSPKSTATNSKITVVVSQELVQSQLVDFKHLMSVHPNLVVIVPPMVANKFHRALKSSVGHDHGVKVIRCDTDVGVIHVIKHIRPDLALIADGVGDNIQGEIKRFVGSSEALSGDVNLAAERLTGL

SEQ ID NO: 69 - protein, 386 aa, Yarrowia lipolytica
  MISC_FEATURE (1)..(386): YlPex26p; GenBank Accession No. NC_006072, antisense translation of nucleotides 117230-118387
MPPAMPQMTTSTLLTDSVTSAVNQAATPKVDQMYQTFGESAREFVNKNFYNSYELIRPFFDEITAKGAQQNGSTVLDAENPHNIPLSLWIKVWSLYLAILDASCKQAGEALLNSTGDLSGSDSGEWNQTRKLLARKLTSGSVWDELVTASGGTGNIHPTILALLASLSIRHDTDAKLMADNLEKFIVTYNDNGSDDVKTKTAFYKVLDLYLLRVLPDLGQWDVAHSFVNNTNLFSHEQKKEMTHKLDQSQKHAEQEHKRLLEEAQEKEKSDAKEKEREERVSRDTQSREIKSPIVDSSTSSRDVTRDTTRELSKSSRQPRTLSQIISTSLKSQFDGNAIFRTLALIVIVSLSAANPLIRKRVVDTLKMLWIKILQTLSMGFKVSYL

SEQ ID NO: 70 - DNA, 10 bp, Yarrowia lipolytica
  misc_feature (8)..(8): n is a, c, g, or t
  ref <302>: TITLE: CODON-OPTIMIZED GENES FOR THE PRODUCTION OF POLYUNSATURATED FATTY ACIDS IN OLEAGINOUS YEAST
  ref <310>: PATENT DOCUMENT NUMBER: US 7,838,651
  ref <311>: PATENT FILING DATE: 2008-01-23
  ref <312>: PUBLICATION DATE: 2010-11-23
  ref <313>: RELEVANT RESIDUES IN SEQ ID NO: (1)..(10)
mammatgnhs

SEQ ID NO: 71 - protein, 5 aa, Artificial Sequence
  Variant His box
  misc_feature (2)..(3): Xaa can be any naturally occurring amino acid
QXXHH

SEQ ID NO: 72 - protein, 5 aa, Artificial Sequence
  His box
  misc_feature (2)..(3): Xaa can be any naturally occurring amino acid
HXXHH

SEQ ID NO: 73 - protein, 13 aa, Artificial Sequence
  delta-9 elongase motif
  misc_feature (3)..(3): Xaa can be any naturally occurring amino acid
  MISC_FEATURE (4)..(4): X = L or F
  misc_feature (5)..(8): Xaa can be any naturally occurring amino acid
  misc_feature (10)..(11): Xaa can be any naturally occurring amino acid
  ref <302>: TITLE: DELTA-9 ELONGASES AND THEIR USE IN MAKING POLYUNSATURATED FATTY ACIDS
  ref <310>: PATENT DOCUMENT NUMBER: US 7,645,604
  ref <311>: PATENT FILING DATE: 2006-11-16
  ref <312>: PUBLICATION DATE: 2010-01-12
  ref <313>: RELEVANT RESIDUES IN SEQ ID NO: (1)..(13)
YNXXXXXXSXXSF

SEQ ID NO: 74 - protein, 15 aa, Artificial Sequence
  delta-9 elongase motif
  misc_feature (3)..(3): Xaa can be any naturally occurring amino acid
  misc_feature (6)..(7): Xaa can be any naturally occurring amino acid
  MISC_FEATURE (8)..(8): X = E or D
  misc_feature (10)..(10): Xaa can be any naturally occurring amino acid
  MISC_FEATURE (12)..(12): X = T or S
  misc_feature (13)..(14): Xaa can be any naturally occurring amino acid
  ref <302>: TITLE: DELTA-9 ELONGASES AND THEIR USE IN MAKING POLYUNSATURATED FATTY ACIDS
  ref <310>: PATENT DOCUMENT NUMBER: U.S. 7,645,604
  ref <311>: PATENT FILING DATE: 2006-11-16
  ref <312>: PUBLICATION DATE: 2010-01-12
  ref <313>: RELEVANT RESIDUES IN SEQ ID NO: (1)..(15)
FYXSKXXXYXDXXXL

SEQ ID NO: 75 - protein, 9 aa, Artificial Sequence
  delta-9 elongase motif
  MISC_FEATURE (2)..(2): X = Q or H
  misc_feature (3)..(3): Xaa can be any naturally occurring amino acid
  misc_feature (7)..(7): Xaa can be any naturally occurring amino acid
  ref <302>: TITLE: DELTA-9 ELONGASES AND THEIR USE IN MAKING POLYUNSATURATED FATTY ACIDS
  ref <310>: PATENT DOCUMENT NUMBER: U.S. 7,645,604
  ref <311>: PATENT FILING DATE: 2006-11-16
  ref <312>: PUBLICATION DATE: 2010-01-12
  ref <313>: RELEVANT RESIDUES IN SEQ ID NO: (1)..(9)
LXXFHHXGA

SEQ ID NO: 76 - protein, 14 aa, Artificial Sequence
  delta-9 elongase motif
  misc_feature (3)..(3): Xaa can be any naturally occurring amino acid
  misc_feature (6)..(12): Xaa can be any naturally occurring amino acid
  MISC_FEATURE (13)..(13): X = K or R or N
  ref <302>: TITLE: DELTA-9 ELONGASES AND THEIR USE IN MAKING POLYUNSATURATED FATTY ACIDS
  ref <310>: PATENT DOCUMENT NUMBER: U.S. 7,645,604
  ref <311>: PATENT FILING DATE: 2006-11-16
  ref <312>: PUBLICATION DATE: 2010-01-12
  ref <313>: RELEVANT RESIDUES IN SEQ ID NO: (1)..(14)
MYXYYXXXXXXXXF

SEQ ID NO: 77 - protein, 8 aa, Artificial Sequence
  delta-9 elongase motif
  misc_feature (2)..(2): Xaa can be any naturally occurring amino acid
  MISC_FEATURE (4)..(4): X = I or L or M
  misc_feature (6)..(7): Xaa can be any naturally occurring amino acid
  ref <302>: TITLE: DELTA-9 ELONGASES AND THEIR USE IN MAKING POLYUNSATURATED FATTY ACIDS
  ref <310>: PATENT DOCUMENT NUMBER: U.S. 7,645,604
  ref <311>: PATENT FILING DATE: 2006-11-16
  ref <312>: PUBLICATION DATE: 2010-01-12
  ref <313>: RELEVANT RESIDUES IN SEQ ID NO: (1)..(8)
KXLXTXXQ

SEQ ID NO: 78 - protein, 7 aa, Artificial Sequence
  delta-9 elongase motif
  misc_feature (2)..(2): Xaa can be any naturally occurring amino acid
  misc_feature (6)..(6): Xaa can be any naturally occurring amino acid
  ref <302>: TITLE: DELTA-9 ELONGASES AND THEIR USE IN MAKING POLYUNSATURATED FATTY ACIDS
  ref <310>: PATENT DOCUMENT NUMBER: U.S. 7,645,604
  ref <311>: PATENT FILING DATE: 2006-11-16
  ref <312>: PUBLICATION DATE: 2010-01-12
  ref <313>: RELEVANT RESIDUES IN SEQ ID NO: (1)..(7)
WXFNYXY

SEQ ID NO: 79 - protein, 9 aa, Artificial Sequence
  delta-9 elongase motif
  misc_feature (2)..(2): Xaa can be any naturally occurring amino acid
  misc_feature (4)..(4): Xaa can be any naturally occurring amino acid
  misc_feature (6)..(7): Xaa can be any naturally occurring amino acid
  ref <302>: TITLE: DELTA-9 ELONGASES AND THEIR USE IN MAKING POLYUNSATURATED FATTY ACIDS
  ref <310>: PATENT DOCUMENT NUMBER: U.S. 7,645,604
  ref <311>: PATENT FILING DATE: 2006-11-16
  ref <312>: PUBLICATION DATE: 2010-01-12
  ref <313>: RELEVANT RESIDUES IN SEQ ID NO: (1)..(9)
YXGXVXXLF

SEQ ID NO: 80 - DNA, 1449 bp, Yarrowia lipolytica
  CDS (1)..(1449): delta-9 desaturase; GenBank Accession No. XM_501496
atggtgaaaaacgtggaccaagtggatctctcgcaggtcgacaccattgcctccggccgagatgtcaactacaaggtcaagtacacctccggcgttaagatgagccagggcgcctacgacgacaagggccgccacatttccgagcagcccttcacctgggccaactggcaccagcacatcaactggctcaacttcattctggtgattgcgctgcctctgtcgtcctttgctgccgctcccttcgtctccttcaactggaagaccgccgcgtttgctgtcggctattacatgtgcaccggtctcggtatcaccgccggctaccaccgaatgtgggcccatcgagcctacaaggccgctctgcccgttcgaatcatccttgctctgtttggaggaggagctgtcgagggctccatccgatggtgggcctcgtctcaccgagtccaccaccgatggaccgactccaacaaggacccttacgacgcccgaaagggattctggttctcccactttggctggatgctgcttgtgcccaaccccaagaacaagggccgaactgacatttctgacctcaacaacgactgggttgtccgactccagcacaagtactacgtttacgttctcgtcttcatggccattgttctgcccaccctcgtctgtggctttggctggggcgactggaagggaggtcttgtctacgccggtatcatgcgatacacctttgtgcagcaggtgactttctgtgtcaactcccttgcccactggattggagagcagcccttcgacgaccgacgaactccccgagaccacgctcttaccgccctggtcacctttggagagggctaccacaacttccaccacgagttcccctcggactaccgaaacgccctcatctggtaccagtacgaccccaccaagtggctcatctggaccctcaagcaggttggtctcgcctgggacctccagaccttctcccagaacgccatcgagcagggtctcgtgcagcagcgacagaagaagctggacaagtggcgaaacaacctcaactggggtatccccattgagcagctgcctgtcattgagtttgaggagttccaagagcaggccaagacccgagatctggttctcatttctggcattgtccacgacgtgtctgcctttgtcgagcaccaccctggtggaaaggccctcattatgagcgccgtcggcaaggacggtaccgctgtcttcaacggaggtgtctaccgacactccaacgctggccacaacctgcttgccaccatgcgagtttcggtcattcgaggcggcatggaggttgaggtgtggaagactgcccagaacgaaaagaaggaccagaacattgtctccgatgagagtggaaaccgaatccaccgagctggtctccaggccacccgggtcgagaaccccggtatgtctggcatggctgcttag

SEQ ID NO: 81 - protein, 482 aa, Yarrowia lipolytica
MVKNVDQVDLSQVDTIASGRDVNYKVKYTSGVKMSQGAYDDKGRHISEQPFTWANWHQHINWLNFILVIALPLSSFAAAPFVSFNWKTAAFAVGYYMCTGLGITAGYHRMWAHRAYKAALPVRIILALFGGGAVEGSIRWWASSHRVHHRWTDSNKDPYDARKGFWFSHFGWMLLVPNPKNKGRTDISDLNNDWVVRLQHKYYVYVLVFMAIVLPTLVCGFGWGDWKGGLVYAGIMRYTFVQQVTFCVNSLAHWIGEQPFDDRRTPRDHALTALVTFGEGYHNFHHEFPSDYRNALIWYQYDPTKWLIWTLKQVGLAWDLQTFSQNAIEQGLVQQRQKKLDKWRNNLNWGIPIEQLPVIEFEEFQEQAKTRDLVLISGIVHDVSAFVEHHPGGKALIMSAVGKDGTAVFNGGVYRHSNAGHNLLATMRVSVIRGGMEVEVWKTAQNEKKDQNIVSDESGNRIHRAGLQATRVENPGMSGMAA

SEQ ID NO: 82 - DNA, 4313 bp, Artificial Sequence
  Plasmid pZKUM
taatcgagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggtaccgggccccccctcgaggtcgacgagtatctgtctgactcgtcattgccgcctttggagtacgactccaactatgagtgtgcttggatcactttgacgatacattcttcgttggaggctgtgggtctgacagctgcgttttcggcgcggttggccgacaacaatatcagctgcaacgtcattgctggctttcatcatgatcacatttttgtcggcaaaggcgacgcccagagagccattgacgttctttctaatttggaccgatagccgtatagtccagtctatctataagttcaactaactcgtaactattaccataacatatacttcactgccccagataaggttccgataaaaagttctgcagactaaatttatttcagtctcctcttcaccaccaaaatgccctcctacgaagctcgagtgctcaagctcgtggcagccaagaaaaccaacctgtgtgcttctctggatgttaccaccaccaaggagctcattgagcttgccgataaggtcggaccttatgtgtgcatgatcaaaacccatatcgacatcattgacgacttcacctacgccggcactgtgctccccctcaaggaacttgctcttaagcacggtttcttcctgttcgaggacagaaagttcgcagatattggcaacactgtcaagcaccagtaccggtgtcaccgaatcgccgagtggtccgatatcaccaacgcccacggtgtacccggaaccggaatcgattgctggcctgcgagctggtgcgtacgaggaaactgtctctgaacagaagaaggaggacgtctctgactacgagaactcccagtacaaggagttcctagtcccctctcccaacgagaagctggccagaggtctgctcatgctggccgagctgtcttgcaagggctctctggccactggcgagtactccaagcagaccattgagcttgcccgatccgaccccgagtttgtggttggcttcattgcccagaaccgacctaagggcgactctgaggactggcttattctgacccccggggtgggtcttgacgacaagggagacgctctcggacagcagtaccgaactgttgaggatgtcatgtctaccggaacggatatcataattgtcggccgaggtctgtacggccagaaccgagatcctattgaggaggccaagcgataccagaaggctggctgggaggcttaccagaagattaactgttagaggttagactatggatatgtaatttaactgtgtatatagagagcgtgcaagtatggagcgcttgttcagcttgtatgatggtcagacgacctgtctgatcgagtatgtatgatactgcacaacctgtgtatccgcatgatctgtccaatggggcatgttgttgtgtttctcgatacggagatgctgggtacagtgctaatacgttgaactacttatacttatatgaggctcgaagaaagctgacttgtgtatgacttaat

SEQ ID NO: 83 - DNA, 13565 bp, Artificial Sequence
  Plasmid pZKL3-9DP9N
gtacggattgtgtatgtccctgtacctgcatcttgatggagagagctccggaaagcggatcaggagctgtccaattttaattttataacatggaaacgagtccttggagctagaagaccattttttcaactgccctatcgactatatttatctactccaaaaccgactgcttcccaagaatcttcagccaaggcttccaaagtaacccctcgcttcccgacacttaattgaaaccttagatgcagtcactgcgagtgaagtggactctaacatctccaacatagcgacgatattgcgagggtttgaatataactaagatgcatgatccattacatttgtagaaatatcataaacaacgaagcacatagacagaatgctgttggttgttacatctgaagccgaggtaccgatgtcattttcagctgtcactgcagagacaggggtatgtcacatttgaagatcatacaaccgacgtttatgaaaaccagagatatagagaatgtattgacggttgtggctatgtcataagtgcagtgaagtgcagtgattataggtatagtacacttactgtagctacaagtacatactgctacagtaatactcatgtatgcaaaccgtattctgtgtctacagaaggcgatacggaagagtcaatctcttatgtagagccatttctataatcgaaggggccttgtaatttccaaacgagtaattgagtaattgaagagcatcgtagacattacttatcatgtattgtgagagggaggagatgcagctgtagctactgcacatactgtactcgcccatgcagggataatgcatagcgagacttggcagtaggtgacagttgctagctgctacttgtagtcgggtgggtgatagcatggcgcgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgatgcggtgtgaaataccgcacagatgcgtaaggagaaaataccgcatcaggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggcccgacgtcgcatgcaggaatagacatcttcaataggagcattaatacctgtgggatcactgatgtaaacttctcccagagtatgtgaataaccagcgggccatccaacaaagaagtcgttccagtgagtgactcggtacatccgtctttcggggttgatggtaagtccgtcgtctccttgcttaaagaacagagcgtccacgtagtctgcaaaagccttgtttccaagtcgaggctgcccatagttgattagcgttggatcatatccaagattcttcaggttgatgcccatgaatagagcagtgacagctcctagagagtggccagttacgatcaatttgtagtcagtgttgtttccaaggaagtcgaccagacgatcctgtacgttcaccatagtctctctgtatgccttctgaaagccatcatgaacttggcagccaggacaattgatactggcagaagggtttgtggagtttatgtcagtagtgttaagaggagggatactggtcatgtagggttgttggatcgtttggatgtcagtaatagcgtctgcaatggagaaagtgcctcggaaaacaatatacttttcctttttggtgtgatcgtgggccaaaaatccagtaactgaagtcgagaagaaatttcctccaaactggtagtcaagagtcacatcgggaaaatgagcgcaagagtttccacaggtaaaatcgctctgcagggcaaatgggccaggggctctgacacaataggccacgttagatagccatccgtacttgagaacaaagtcgtatgtctcctgggtgataggagccgttaattaagttgcgacacatgtcttgatagtatcttgaattctctctcttgagcttttccataacaagttcttctgcctccaggaagtccatgggtggtttgatcatggttttggtgtagtggtagtgcagtggtggtattgtgactggggatgtagttgagaataagtcatacacaagtcagctttcttcgagcctcatataagtataagtagttcaacgtattagcactgtacccagcatctccgtatcgagaaacacaacaacatgccccattggacagatcatgcggatacacaggttgtgcagtatcatacatactcgatcagacaggtcgtctgaccatcatacaagctgaacaagcgctccatacttgcacgctctctatatacacagttaaattacatatccatagtctaacctctaacagttaatcttctggtaagcctcccagccagccttctggtatcgcttggcctcctcaataggatctcggttctggccgtacagacctcggccgacaattatgatatccgttccggtagacatgacatcctcaacagttcggtactgctgtccgagagcgtctcccttgtcgtcaagacccaccccgggggtcagaataagccagtcctcagagtcgcccttaggtcggttctgggcaatgaagccaaccacaaactcggggtcggatcgggcaagctcaatggtctgcttggagtactcgccagtggccagagagcccttgcaagacagctcggccagcatgagcagacctctggccagcttctcgttgggagaggggactaggaactccttgtactgggagttctcgtagtcagagacgtcctccttcttctgttcagagacagtttcctcggcaccagctcgcaggccagcaatgattccggttccgggtacaccgtgggcgttggtgatatcggaccactcggcgattcggtgacaccggtactggtgcttgacagtgttgccaatatctgcgaactttctgtcctcgaacaggaagaaaccgtgcttaagagcaagttccttgagggggagcacagtgccggcgtaggtgaagtcgtcaatgatgtcgatatgggttttgatcatgcacacataaggtccgaccttatcggcaagctcaatgagctccttggtggtggtaacatccagagaagcacacaggttggttttcttggctgccacgagcttgagcactcgagcggcaaaggcggacttgtggacgttagctcgagcttcgtaggagggcattttggtggtgaagaggagactgaaataaatttagtctgcagaactttttatcggaaccttatctggggcagtgaagtatatgttatggtaatagttacgagttagttgaacttatagatagactggactatacggctatcggtccaaattagaaagaacgtcaatggctctctgggcgtcgcctttgccgacaaaaatgtgatcatgatgaaagccagcaatgacgttgcagctgatattgttgtcggccaaccgcgccgaaaacgcagctgtcagacccacagcctccaacgaagaatgtatcgtcaaagtgatccaagcacactcatagttggagtcgtactccaaaggcggcaatgacgagtcagacagatactcgtcgaccttttccttgggaaccaccaccgtcagcccttctgactcacgtattgtagccaccgacacaggcaacagtccgtggatagcagaatatgtcttgtcggtccatttctcaccaactttaggcgtcaagtgaatgttgcagaagaagtatgtgccttcattgagaatcggtgttgctgatttcaataaagtcttgagatcagtttggccagtcatgttgtggggggtaattggattgagttatcgcctacagtctgtacaggtatactcgctgcccactttatactttttgattccgctgcacttgaagcaatgtcgtttaccaaaagtgagaatgctccacagaacacaccccagggtatggttgagcaaaaaataaacactccgatacggggaatcgaaccccggtctccacggttctcaagaagtattcttgatgagagcgtatcgatggttaatgctgctgtgtgctgtgtgtgtgtgttgtttggcgctcattgttgcgttatgcagcgtacaccacaatattggaagcttattagcctttctattttttcgtttgcaaggcttaacaacattgctgtggagagggatggggatatggaggccgctggagggagtcggagaggcgttttggagcggcttggcctggcgcccagctcgcgaaacgcacctaggaccctttggcacgccgaaatgtgccacttttcagtctagtaacgccttacctacgtcattccatgcgtgcatgtttgcgccttttttcccttgcccttgatcgccacacagtacagtgcactgtacagtggaggttttgggggggtcttagatgggagctaaaagcggcctagcggtacactagtgggattgtatggagtggcatggagcctaggtggagcctgacaggacgcacgaccggctagcccgtgacagacgatgggtggctcctgttgtccaccgcgtacaaatgtttgggccaaagtcttgtcagccttgcttgcgaacctaattcccaattttgtcacttcgcacccccattgatcgagccctaacccctgcccatcaggcaatccaattaagctcgcattgtctgccttgtttagtttggctcctgcccgtttcggcgtccacttgcacaaacacaaacaagcattatatataaggctcgtctctccctcccaaccacactcacttttttgcccgtcttcccttgctaacacaaaagtcaagaacacaaacaaccaccccaacccccttacacacaagacatatctacagcaatggccatggccaaaagcaaacgacggtcggaggctgtggaagagcacgtgaccggctcggacgagggcttgaccgatacttcgggtcacgtgagccctgccgccaagaagcagaagaactcggagattcatttcaccacccaggctgcccagcagttggatcgggagcgcaaggaggagtatctggactcgctgatcgacaacaaggactatctcaagtaccgtcctcgaggctggaagctcaacaacccgcctaccgaccgacctgtgcgaatctacgccgatggagtgtttgatttgttccatctgggacacatgcgtcagctggagcagtccaagaaggccttccccaacgcagtgttgattgtgggcattcccagcgacaaggagacccacaagcggaagggattgaccgtgctgagtgacgtccagcggtacgagacggtgcgacactgcaagtgggtggacgaggtggtggaggatgctccctggtgtgtcaccatggactttctggaaaaacacaaaatcgactacgtggcccatgacgatctgccctacgcttccggcaacgacgatgatatctacaagcccatcaaggagaagggcatgtttctggccacccagcgaaccgagggcatttccacctcggacatcatcaccaagattatccgagactacgacaagtatttaatgcgaaactttgcccggggtgctaaccgaaaggatctcaacgtctcgtggctcaagaagaacgagctggacttcaagcgtcatgtggccgagttccgaaactcgttcaagcgaaagaaggtcggtaaggatctctacggcgagattcgcggtctgctgcagaatgtgctcatttggaacggcgacaactccggcacttccactccccagcgaaagacgctgcagaccaacgccaagaagatgtacatgaacgtgctcaagactctgcaggctcctgacgctgttgacgtggactcctcggagaacgtgtctgagaacgtcactgatgaggaggaggaagacgacgacgaggttgatgaggacgaagaagccgacgacgacgacgaagacgacgaagacgaggaagacgacgagtaggcggccgcattgatgattggaaacacacacatgggttatatctaggtgagagttagttggacagttatatattaaatcagctatgccaacggtaacttcattcatgtcaacgaggaaccagtgactgcaagtaatatagaatttgaccaccttgccattctcttgcactcctttactatatctcatttatttcttatatacaaatcacttcttcttcccagcatcgagctcggaaacctcatgagcaataacatcgtggatctcgtcaatagagggctttttggactccttgctgttggccaccttgtccttgctgtttaaacacgcagtaggatgtcctgcacgggtctttttgtggggtgtggagaaaggggtgcttggagatggaagccggtagaaccgggctgcttgtgcttggagatggaagccggtagaaccgggctgcttggggggatttggggccgctgggctccaaagaggggtaggcatttcgttggggttacgtaattgcggcatttgggtcctgcgcgcatgtcccattggtcagaattagtccggataggagacttatcagccaatcacagcgccggatccacctgtaggttgggttgggtgggagcacccctccacagagtagagtcaaacagcagcagcaacatgatagttgggggtgtgcgtgttaaaggaaaaaaaagaagcttgggttatattcccgctctatttagaggttgcgggatagacgccgacggagggcaatggcgctatggaaccttgcggatatccatacgccgcggcggactgcgtccgaaccagctccagcagcgttttttccgggccattgagccgactgcgaccccgccaacgtgtcttggcccacgcactcatgtcatgttggtgttgggaggccactttttaagtagcacaaggcacctagctcgcagcaaggtgtccgaaccaaagaagcggctgcagtggtgcaaacggggcggaaacggcgggaaaaagccacgggggcacgaattgaggcacgccctcgaatttgagacgagtcacggccccattcgcccgcgcaatggctcgccaacgcccggtcttttgcaccacatcaggttaccccaagccaaacctttgtgttaaaaagcttaacatattataccgaacgtaggtttgggcgggcttgctccgtctgtccaaggcaacatttatataagggtctgcatcgccggctcaattgaatcttttttcttcttctcttctctatattcattcttgaattaaacacacatcaacatggccatcaaagtcggtattaacggattcgggcgaatcggacgaattgtgagtaccatagaaggtgatggaaacatgacccaacagaaacagatgacaagtgtcatcgacccaccagagcccaattgagctcatactaacagtcgacaacctgtcgaaccaattgatgactccccgacaatgtactaacacaggtcctgcccatggtgaaaaacgtggaccaagtggatctctcgcaggtcgacaccattgcctccggccgagatgtcaactacaaggtcaagtacacctccggcgttaagatgagccagggcgcctacgacgacaagggccgccacatttccgagcagcccttcacctgggccaactggcaccagcacatcaactggctcaacttcattctggtgattgcgctgcctctgtcgtcctttgctgccgctcccttcgtctccttcaactggaagaccgccgcgtttgctgtcggctattacatgtgcaccggtctcggtatcaccgccggctaccaccgaatgtgggcccatcgagcctacaaggccgctctgcccgttcgaatcatccttgctctgtttggaggaggagctgtcgagggctccatccgatggtgggcctcgtctcaccgagtccaccaccgatggaccgactccaacaaggacccttacgacgcccgaaagggattctggttctcccactttggctggatgctgcttgtgcccaaccccaagaacaagggccgaactgacatttctgacctcaacaacgactgggttgtccgactccagcacaagtactacgtttacgttctcgtcttcatggccattgttctgcccaccctcgtctgtggctttggctggggcgactggaagggaggtcttgtctacgccggtatcatgcgatacacctttgtgcagcaggtgactttctgtgtcaactcccttgcccactggattggagagcagcccttcgacgaccgacgaactccccgagaccacgctcttaccgccctggtcacctttggagagggctaccacaacttccaccacgagttcccctcggactaccgaaacgccctcatctggtaccagtacgaccccaccaagtggctcatctggaccctcaagcaggttggtctcgcctgggacctccagaccttctcccagaacgccatcgagcagggtctcgtgcagcagcgacagaagaagctggacaagtggcgaaacaacctcaactggggtatccccattgagcagctgcctgtcattgagtttgaggagttccaagagcaggccaagacccgagatctggttctcatttctggcattgtccacgacgtgtctgcctttgtcgagcaccaccctggtggaaaggccctcattatgagcgccgtcggcaaggacggtaccgctgtcttcaacggaggtgtctaccgacactccaacgctggccacaacctgcttgccaccatgcgagtttcggtcattcgaggcggcatggaggttgaggtgtggaagactgcccagaacgaaaagaaggaccagaacattgtctccgatgagagtggaaaccgaatccaccgagctggtctccaggccacccgggtcgagaaccccggtatgtctggcatggctgcttaggcggccgcatgagaagataaatatataaatacattgagatattaaatgcgctagattagagagcctcatactgctcggagagaagccaagacgagtactcaaaggggattacaccatccatatccacagacacaagctggggaaaggttctatatacactttccggaataccgtagtttccgatgttatcaatgggggcagccaggatttcaggcacttcggtgtctcggggtgaaatggcgttcttggcctccatcaagtcgtaccatgtcttcatttgcctgtcaaagtaaaacagaagcagatgaagaatgaacttgaagtgaaggaatttaaatagttggagcaagggagaaatgtagagtgtgaaagactcactatggtccgggcttatctcgaccaatagccaaagtctggagtttctgagagaaaaaggcaagatacgtatgtaacaaagcgacgcatggtacaataataccggaggcatgtatcatagagagttagtggttcgatgatggcactggtgcctggtatgactttatacggctgactacatatttgtcctcagacatacaattacagtcaagcacttacccttggacatctgtaggtaccccccggccaagacgatctcagcgtgtcgtatgtcggattggcgtagctccctcgctcgtcaattggctcccatctactttcttctgcttggctacacccagcatgtctgctatggctcgttttcgtgccttatctatcctcccagtattaccaactctaaatgacatgatgtgattgggtctacactttcatatcagagataaggagtagcacagttgcataaaaagcccaactctaatcagcttcttcctttcttgtaattagtacaaaggtgattagcgaaatctggaagcttagttggccctaaaaaaatcaaaaaaagcaaaaaacgaaaaacgaaaaaccacagttttgagaacagggaggtaacgaaggatcgtatatatatatatatatatatatacccacggatcccgagaccggcctttgattcttccctacaaccaaccattctcaccaccctaattcacaaccatggaggtcgtgaacgaaatcgtctccattggccaggaggttcttcccaaggtcgactatgctcagctctggtctgatgcctcgcactgcgaggtgctgtacctctccatcgccttcgtcatcctgaagttcacccttggtcctctcggacccaagggtcagtctcgaatgaagtttgtgttcaccaactacaacctgctcatgtccatctactcgctgggctccttcctctctatggcctacgccatgtacaccattggtgtcatgtccgacaactgcgagaaggctttcgacaacaatgtcttccgaatcaccactcagctgttctacctcagcaagttcctcgagtacattgactccttctatctgcccctcatgggcaagcctctgacctggttgcagttctttcaccatctcggagctcctatggacatgtggctgttctacaactaccgaaacgaagccgtttggatctttgtgctgctcaacggcttcattcactggatcatgtacggctactattggacccgactgatcaagctcaagttccctatgcccaagtccctgattacttctatgcagatcattcagttcaacgttggcttctacatcgtctggaagtaccggaacattccctgctaccgacaagatggaatgagaatgtttggctggtttttcaactacttctacgttggtactgtcctgtgtctgttcctcaacttctacgtgcagacctacatcgtccgaaagcacaagggagccaaaaagattcagtgagcggccgcaagtgtggatggggaagtgagtgcccggttctgtgtgcacaattggcaatccaagatggatggattcaacacagggatatagcgagctacgtggtggtgcgaggatatagcaacggatatttatgtttgacacttgagaatgtacgatacaagcactgtccaagtacaatactaaacatactgtacatactcatactcgtacccggcaacggtttcacttgagtgcagtggctagtgctcttactcgtacagtgtgcaatactgcgtatcatagtctttgatgtatatcgtattcattcatgttagttgc

SEQ ID NO: 84 - DNA, 9632 bp, Artificial Sequence
  Plasmid pY187
ggccgcatgagaagataaatatataaatacattgagatattaaatgcgctagattagagagcctcatactgctcggagagaagccaagacgagtactcaaaggggattacaccatccatatccacagacacaagctggggaaaggttctatatacactttccggaataccgtagtttccgatgttatcaatgggggcagccaggatttcaggcacttcggtgtctcggggtgaaatggcgttcttggcctccatcaagtcgtaccatgtcttcatttgcctgtcaaagtaaaacagaagcagatgaagaatgaacttgaagtgaaggaatttaaatgtaacgaaactgaaatttgaccagatattgtgtccgcggtggagctccagcttttgttccctttagtgagggttaatttcgagcttggcgtaatcatggtcatagctgtttcctgtgtgaaattgttatccgctcacaagcttccacacaacgtacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggtaccgggccctccttcacttcaagttcattcttcatctgcttctgttttactttgacaggcaaatgaagacatggtacgacttgatggaggccaagaacgccatttcaccccgagacaccgaagtgcctgaaatcctggctgcccccattgataacatcggaaactacggtattccggaaagtgtatatagaacctttccccagcttgtgtctgtggatatggatggtgtaatcccctttgagtactcgtcttggcttctctccgagcagtatgaggctctctaatctagcgcatttaatatctcaatgtatttatatatttatcttctcatgcggccgcctactgagtcttctggccagcgtagccaatctggtcggcagtctcgcacatggccttataagtggtggccatgagagcgtcgacgttgctggcgtccagacccttggtctcaatggggctcaggacgtcgacaaggatctctccggcgtccagcttgcctcggccgaaagaaaacattcgggaggtgttctggaccaccacggggacaatgggagcgcccgactggaccgccaggtggaaacagcccttcttgaagggcatgatgccgacgtccttggagtaggatcgggttccctcggggaacatgaagacgctctggcccttgcctccgttgccgctctggatggtcttgacggcgccgccgagggtctgcacggacttggttcggtcctttcggtccaggaagatggtgccggacagcgccatgaactggcccagcagagggtaccacttgagggcctttttggcggtgacggagcagtactgggggaagatgcgaccgagcaccagaatgtccatttcgttctggtggttggaaatcagaatgcatggtcggggcaggtgtttggtgatgtcgtcaatgggcttggtggtgttggcgacctggatcttggaggcatccagaccggcggttccggtcacctgccggctacgcagcttgatgctgatacccaggaagatgcgcaccgagtagtagaaggctctggcaacggtccattgggccaggccctgcttgccgatggcggtgagaatggtggacgccagcacgccgtaggtggcacaggcggcaaagatgaccacggcgatggcggcgcggacgtagaagacgagcttggatgcaacggacatgagctgggttagtttgtgtagagagtgtgtgttgctagcgactttcggattgtgtcattacacaaaacgcgtcgtctcgacactgatcttgtcgtggatactcacggctcggaattctgtgatgtgtagtttagatttcgaatctgtggggaaagaaaggaaaaaagagactggcaaccgattgggagagccactgtttatatataccctagacaagccccccgcttgtaagatgttggtcaatgtaaaccagtattaaggttggcaagtgcaggagaagcaaggtgtgggtaccgagcaatggaaatgtgcggaaggcaaaaaaatgaggccacggcctattgtcggggctatatccagggggcgattgaagtacactaacatgacatgtgtccacagaccctcaatctggcctgatgagccaaatccatacgcgctttcgcagctctaaaggctataacaagtcacaccaccctgctcgacctcagcgccctcactttttgttaagacaaactgtacacgctgttccagcgttttctgcctgcacctggtgggacatttggtgcaacctaaagtgctcggaacctctgtggtgtccagatcagcgcagcagttccgaggtagttttgaggcccttagatgatgcaatggtgtcagtcgctggatcacgagtcttaatggcagtattcgttcttatttgtgccattgagccccgttatcctcgtatcttctaccccccatcccatccctttgttggtgcaaccctacccatttattgttgggtgcagcccaaccgacgtggagagcttggcttggccatataaaaaggcccccccctagtggcaatggcagaaagtcagctgtgagttgttgaatttgtcatctaggcggcctggccgtcttctgcatgctacttgggtgtaatattgggatctgttcggaaatcaacggatgctcaatcgatttcgacagtaattaattaagtcatacacaagtcagctttcttcgagcctcatataagtataagtagttcaacgtattagcactgtacccagcatctccgtatcgagaaacacaacaacatgccccattggacagatcatgcggatacacaggttgtgcagtatcatacatactcgatcagacaggtcgtctgaccatcatacaagctgaacaagcgctccatacttgcacgctctctatatacacagttaaattacatatccatagtctaacctctaacagttaatcttctggtaagcctcccagccagccttctggtatcgcttggcctcctcaataggatctcggttctggccgtacagacctcggccgacaattatgatatccgttccggtagacatgacatcctcaacagttcggtactgctgtccgagagcgtctcccttgtcgtcaagacccaccccgggggtcagaataagccagtcctcagagtcgcccttaggtcggttctgggcaatgaagccaaccacaaactcggggtcggatcgggcaagctcaatggtctgcttggagtactcgccagtggccagagagcccttgcaagacagctcggccagcatgagcagacctctggccagcttctcgttgggagaggggactaggaactccttgtactgggagttctcgtagtcagagacgtcctccttcttctgttcagagacagtttcctcggcaccagctcgcaggccagcaatgattccggttccgggtacaccgtgggcgttggtgatatcggaccactcggcgattcggtgacaccggtactggtgcttgacagtgttgccaatatctgcgaactttctgtcctcgaacaggaagaaaccgtgcttaagagcaagttccttgagggggagcacagtgccggcgtaggtgaagtcgtcaatgatgtcgatatgggttttgatcatgcacacataaggtccgaccttatcggcaagctcaatgagctccttggtggtggtaacatccagagaagcacacaggttggttttcttggctgccacgagcttgagcactcgagcggcaaaggcggacttgtggacgttagctcgagcttcgtaggagggcattttggtggtgaagaggagactgaaataaatttagtctgcagaactttttatcggaaccttatctggggcagtgaagtatatgttatggtaatagttacgagttagttgaacttatagatagactggactatacggctatcggtccaaattagaaagaacgtcaatggctctctgggcgtcgcctttgccgacaaaaatgtgatcatgatgaaagccagcaatgacgttgcagctgatattgttgtcggccaaccgcgccgaaaacgcagctgtcagacccacagcctccaacgaagaatgtatcgtcaaagtgatccaagcacactcatagttggagtcgtactccaaaggcggcaatgacgagtcagacagatactcgtcgaccgtacgatagttagtagacaacaatcgatagttggagcaagggagaaatgtagagtgtgaaagactcactatggtccgggcttatctcgaccaatagccaaagtctggagtttctgagagaaaaaggcaagatacgtatgtaacaaagcgacgcatggtacaataataccggaggcatgtatcatagagagttagtggttcgatgatggcactggtgcctggtatgactttatacggctgactacatatttgtcctcagacatacaattacagtcaagcacttacccttggacatctgtaggtaccccccggccaagacgatctcagcgtgtcgtatgtcggattggcgtagctccctcgctcgtcaattggctcccatctactttcttctgcttggctacacccagcatgtctgctatggctcgttttcgtgccttatctatcctcccagtattaccaactctaaatgacatgatgtgattgggtctacactttcatatcagagataaggagtagcacagttgcataaaaagcccaactctaatcagcttcttcctttcttgtaattagtacaaaggtgattagcgaaatctggaagcttagttggccctaaaaaaatcaaaaaaagcaaaaaacgaaaaacgaaaaaccacagttttgagaacagggaggtaacgaaggatcgtatatatatatatatatatatatacccacggatcccgagaccggcctttgattcttccctacaaccaaccattctcaccaccctaattcacaaccatgacacaacctgtgaatcggaaggcgactgtcgagcgggtcgagccagcagtggaggtggctgactccgagtccgaggccaagaccgacgtccacgttcaccaccatcatcaccaccacaagcgaaaatccgtcaagggcaagattctcaacttcttcacccgaagtcgacgtatcaccttcgtcctcggcgccgtggtcggtgtgatagccgcgggatactacgctgcgccaccggagctcagcattgatatcgatgctcttctcggcgacttgccctcgttcgactttgacgctctatctctcgacaacttgtccatggacagtgtgtcggactttgtacaagacatgaaatcgcggtttccgaccaagattctgcaggaggcggccaagatcgagaagcaccagaaaagcgaacagaaggctgccccttttgctgtgggcaaggctatgaagagcgagggactcaacgccaagtacccggtggtgctggtgcccggcgtcatctccacgggactggagagctggtccctggagggaaccgaggagtgtcccaccgagtcgcacttcagaaagcgaatgtggggctcctggtacatgatccgagtcatgctgctggacaagtactgctggctgcagaacctgatgctggacacagagaccggtctagaccctccccatttcaagctgcgagccgcccagggatttgcctccgccgacttctttatggcaggctactggctgtggaacaagctgctcgagaacctggctgttattggatacgatacggatacaatgtctgctgcggcgtacgactggagactgtcctaccctgatttggagcaccgagacggatacttctccaagctcaaagcttcaatcgaagagactaagcgtatgacaggtgagaagacagttctgacgggccattccatgggctcccaggtcatcttctacttcatgaagtgggctgaggccgagggatatggaggaggaggtcccaactgggtcaatgaccatattgaatcctttgtcgacatttccggctccatgctgggtactcccaagaccctggttgctcttctgtctggagaaatgaaggataccgtgcagctgaacgcgatggctgtgtatggactggagcagttcttctctcgacgagagcgagccgatctgctgcgaacatggggaggaattgcttccatgattcccaagggtggtaaggctatctggggtgatcattctggagcccctgatgacgagcccggccagaatgtcacctttggcaacttcatcaagttcaaggagtccttgaccgagtactctgctaagaacctcaccatggatgaaaccgttgacttcctgtattctcagtctcccgagtggtttgtgaaccgaaccgagggtgcttactcctttggaattgccaagactcgaaagcaggttgagcagaatgagaagcgaccttctacctggagcaaccctctggaagctgctctccccaatgcccccgatctcaagatctactgcttctatggagtcggtaaggataccgagcgagcctactactaccaggatgagcccaatcccgagcagaccaacttgaacgtcagtatcgctggaaacgaccctgatggtgtgcttatgggtcagggcgatggaaccgtctcccttgtgacccataccatgtgtcaccgatggaaggacgagaattccaagttcaaccctggtaacgcccaggtcaaggttgtggagatgttgcaccagcctgatcgacttgatattcgaggcggtgctcagactgccgagcatgtggacattctggggcgttctgagttgaacgagatggttctgaaggtggctagtggaaagggaaatgagattgaagagagagtcatctccaacattgatgagtgggtgtggaagattgatctcggcagcaattaggc

SEQ ID NO: 85 - DNA, 15262 bp, Artificial Sequence
  Plasmid pZK16-ML8N
gtacgcattcttgacttgctccccagttgccctttttggtcataactcagccccgactctctccccaaagaggagatggacttacaatagatacgagacaacagatattttcggccacctggtgcaattggtctgttttattacccccaataatatccacagcgtccgaatcagctcgacaagctctttctcagcatactgatcttaccccataccccccagacagcggtgccatatccatacccgcactacctgagacagtaaactcagggcaaggagcggtcttggtccatcgcgacgctgtaagctttgcctttgcgttttgtgatccaccacacggcagtcaaggtctcggttgaaagatgggtctggcaatgtggattgctgaatcattgacatataaatacgagtgatcctgccatttcccaatctttagaaatcatcttttcttcacacatacaaaaaacacacatcacaatgcagttctccgccgccgccgtccttgccctcgccgccttcgtctctgcccaggccgcctccgctgcttctgaagctggtggtgccgttgtctccggtgcctccggtgccgctgccgccgcttcttctgctgtcattggctccgagtctcaggccgcttcttctgctgcctcttctgctgctgagtctgcttcttccgctgcctctgagtccgcctcctccgcttccgcctccgagtccaaggcctctgagtccgcttccaagtccgcctccaaggcttctgagtctgcttccaaggccgagtcttctgctgccaaggcttcctccgctgctggttctgcttcttccgccgctgcctctgccaccaagtctggtgatgcctccggctcttccaagccttccggctctgcctcctctaccggtgacaagtccggtgctggtattgttgcccccgctgttggtgccatcgttgtcggtgctcttgctcagctcatctaagcggtctttgtacaactacccacttaatatttatattatgatatagactgcaatactattgcatgtgtaatgcttcgtttgaaagtcgtagtccggccattcatggcagtgtatggcagtattgcaaccaattggcttaataacatatacaaagtggcaattctgtgttcgaaccatcacacaacccaacatatttgacattgctacaagtattcgacttgttcttcggccgcacgacatgcattgctagcagcacacttgcagaagcttggccaatggttaggttgacctttaaccagtaaaacgcaatataggttgccaattaacaaacaacacagcccagaactggtgtaaagggcttgggttttgtgcaatcaactcattgactcacctcccccaatgctccatgaacccatgaatccatagtacctccatcccaattcagagaggctcagaaacacgcaattggcaaaagtaaacaaaggtctcgaaaccttaaggggtgcagtgttgcaaagttaaaattacactgttggatggtgttccactcaaactgtggatggatcagacggttgcactaaaccaagattcaatatgctctacaagtagcgtgccatgaggtgtataatatcacacatgatcagagttaaggcctggaaaaaaagtgtccgcggctatgtaacactgctgaatacagtgtgtgccgtttccacggactggaatgaatgcactcaacacgttggtagctaacttccccaactattgacttcactttactgtagctactctaagtacgataatgacatcatgaatcaccaactttatcttccccaccgaaagtaagagatgaaagagaggctaacagcttttgtaagaaaatcacaaaatctacttaccgtattacaaaagtacaagtatcagtaaccaggcgcgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgatgcggtgtgaaataccgcacagatgcgtaaggagaaaataccgcatcaggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggcccgacgtcgcatgctatgtacactgtgtgagtgtagagggcaatggtggtgacaactgagctactatacacacacagcttgtactggtataagttgtgagctacagtacaagtaatactacaaaattcagtatgtacaagtatgccggtacggcagtagcatgtatcaaagagagacagaaagaaggctggaaagcgaaggccagctgagcgtgggaaccgcagtacgtggaagtgccaaacctgcgacagaatgacatggtcttgcactttttaccggtaccggtacagtacgataccggtacgcacttgctacagtagatcatagaccaccagaataaccctgcattagcgccacgttgccaagccctcaactttctttgcagctacaccttttacaccttttaggctgccaggaagagcataaatgaattgtacttgggggcacagaatttgggttgaagtgttcctgggagagaatgtgcttggctgtatagttgggtggctctccttcatagtagatgtgaggttacagcacttgtagattgtgtacgcgttctgtttaaggtggtaccagtattatgggttgacgtgaaagaaagggaggaggcaggggtacagcaagagtgtgggcgcacactcacacatgaagcaagacctgtttcgtcatttctatttgtttaacaaggacgacataatatacttaggacagcatgggccgaccggcaggaataatctgcaaacacaatcgtattgtggcgtcccctctcgatcacgatagttgctaagtttagcagtctgagagtttggctgtgacgcaagaccgagagagagacagagagttgtcccagtttgagtactcgtaccgtactacagagtaaatcgaaatcgagcgctcactttctgcactttgtgaaggcgcagcattcaacatttgtgtccagcccctttccgtttgaagcgacttgaccacgaaatgttggaataaagctgtgttacatacgagacctacaagtagagtgtcggatatgccaactgaacaggttagatgaaagttactcaacaacaggagagcggacaccaacgtgcgaaaatgtacggatgaacccattgtctgtccgcatagcaatctgttttcgccagcagtgcttgtgtcgttggattgctgccattgtactatttgtactttgttccattaacactcgcatcttgctcaccgattagcagcactcctgttgcctcactgggcttgtctgtttcagggtggaatgcatgagcaatgcgatcgtcaaggggaggttgaaagcgcgtatggaataactgtggttctatagctgaggggaggatatcgaggacagccacggttcagtgggggatttcgggagctactcagtaacatgtactcttgtccgaacgccctgctgatggcaaatatgacaaaacgcaacaatgtggagcaacatttccatttcgagagatattacatgggttgcattggggcctgggcatcccgtgcaataaccgagaccatgtgaaggtgcacgatcgacacttatccagccagtcatacgtggtgtcgcaagctaagcaacaatgggattcacgaatctatgtgggggaacgtgcacaggggaaatgaaacaaaacggaggagggggtctttgaaaatgtagagaaatataacaaaaaatcacaaaaacgcaccaaaaatatgccaaaatcgtcaacagtggaaatcacgcgcccctggctcgacttcccactgacataccccccctcaaccaatatcatatccaccctagccaatcgcttaattaagttgcgacacatgtcttgatagtatcttgaattctctctcttgagcttttccataacaagttcttctgcctccaggaagtccatgggtggtttgatcatggttttggtgtagtggtagtgcagtggtggtattgtgactggggatgtagttgagaataagtcatacacaagtcagctttcttcgagcctcatataagtataagtagttcaacgtattagcactgtacccagcatctccgtatcgagaaacacaacaacatgccccattggacagatcatgcggatacacaggttgtgcagtatcatacatactcgatcagacaggtcgtctgaccatcatacaagctgaacaagcgctccatacttgcacgctctctatatacacagttaaattacatatccatagtctaacctctaacagttaatcttctggtaagcctcccagccagccttctggtatcgcttggcctcctcaataggatctcggttctggccgtacagacctcggccgacaattatgatatccgttccggtagacatgacatcctcaacagttcggtactgctgtccgagagcgtctcccttgtcgtcaagacccaccccgggggtcagaataagccagtcctcagagtcgcccttaggtcggttctgggcaatgaagccaaccacaaactcggggtcggatcgggcaagctcaatggtctgcttggagtactcgccagtggccagagagcccttgcaagacagctcggccagcatgagcagacctctggccagcttctcgttgggagaggggactaggaactccttgtactgggagttctcgtagtcagagacgtcctccttcttctgttcagagacagtttcctcggcaccagctcgcaggccagcaatgattccggttccgggtacaccgtgggcgttggtgatatcggaccactcggcgattcggtgacaccggtactggtgcttgacagtgttgccaatatctgcgaactttctgtcctcgaacaggaagaaaccgtgcttaagagcaagttccttgagggggagcacagtgccggcgtaggtgaagtcgtcaatgatgtcgatatgggttttgatcatgcacacataaggtccgaccttatcggcaagctcaatgagctccttggtggtggtaacatccagagaagcacacaggttggttttcttggctgccacgagcttgagcactcgagcggcaaaggcggacttgtggacgttagctcgagcttcgtaggagggcattttggtggtgaagaggagactgaaataaatttagtctgcagaactttttatcggaaccttatctggggcagtgaagtatatgttatggtaatagttacgagttagttgaacttatagatagactggactatacggctatcggtccaaattagaaagaacgtcaatggctctctgggcgtcgcctttgccgacaaaaatgtgatcatgatgaaagccagcaatgacgttgcagctgatattgttgtcggccaaccgcgccgaaaacgcagctgtcagacccacagcctccaacgaagaatgtatcgtcaaagtgatccaagcacactcatagttggagtcgtactccaaaggcggcaatgacgagtcagacagatactcgtcgaccttttccttgggaaccaccaccgtcagcccttctgactcacgtattgtagccaccgacacaggcaacagtccgtggatagcagaatatgtcttgtcggtccatttctcaccaactttaggcgtcaagtgaatgttgcagaagaagtatgtgccttcattgagaatcggtgttgctgatttcaataaagtcttgagatcagtttggccagtcatgttgtggggggtaattggattgagttatcgcctacagtctgtacaggtatactcgctgcccactttatactttttgattccgctgcacttgaagcaatgtcgtttaccaaaagtgagaatgctccacagaacacaccccagggtatggttgagcaaaaaataaacactccgatacggggaatcgaaccccggtctccacggttctcaagaagtattcttgatgagagcgtatcgatagttggagcaagggagaaatgtagagtgtgaaagactcactatggtccgggcttatctcgaccaatagccaaagtctggagtttctgagagaaaaaggcaagatacgtatgtaacaaagcgacgcatggtacaataataccggaggcatgtatcatagagagttagtggttcgatgatggcactggtgcctggtatgactttatacggctgactacatatttgtcctcagacatacaattacagtcaagcacttacccttggacatctgtaggtaccccccggccaagacgatctcagcgtgtcgtatgtcggattggcgtagctccctcgctcgtcaattggctcccatctactttcttctgcttggctacacccagcatgtctgctatggctcgttttcgtgccttatctatcctcccagtattaccaactctaaatgacatgatgtgattgggtctacactttcatatcagagataaggagtagcacagttgcataaaaagcccaactctaatcagcttcttcctttcttgtaattagtacaaaggtgattagcgaaatctggaagcttagttggccctaaaaaaatcaaaaaaagcaaaaaacgaaaaacgaaaaaccacagttttgagaacagggaggtaacgaaggatcgtatatatatatatatatatatatacccacggatcccgagaccggcctttgattcttccctacaaccaaccattctcaccaccctaattcacaaccatgtctattggttcgtccaaccccgtgctcttggctgcgattcccttcgtctacctgtttgtcctcccacgagtcctggctttcctgcctcagaaggctcagttcctggccaaatgtattgtggtcctgattgccacgcttatcatgtccgttgcaggctgcttcatctcgatcgtgtgcgctcttctggacaagagatacgtcatcaattacgttgtgtcgcgattgttctccttccttgccgctcgaccgtgtggtgtgacctataagattgttggtgaggaacacctcgataagtaccctgctatcgtggtctgtaaccatcaatcctctatggatatgatggttttgggacgagtttttccaaagcactgcgttgtcatggcgaagaaggaactcctgtactttccctttttgggaatgtttatgaaactgagcaacgctatcttcatcgaccggaagaaccacaagaaagccatcgagtctaccacccaagccgtggcggacatgaagaagcacaactctggaatctggattttcccagagggcacccggtctagactggacaaggcagacctgctgcccttcaagaaaggtgcctttcatcttgcaattcaggcccagctccctattctccccattatctcgcagggctattcccatatctacgactcttcgaagcggtacttccccggtggagagctcgagatcagagtcctggagcccattcctacaactggcctcactactgatgatgtgaacgacctgatggacaagacacgaaaccttatgctcaagcacttgaaggagatggattcccagtattcgtcgagcactgctgaaaatggatccacgcacatcgacgccgatattgccaagtctacagccaccagcattggcaacactgacgacgcaattacaaaacgtcgtacccctaaggaataagcggccgcattgatgattggaaacacacacatgggttatatctaggtgagagttagttggacagttatatattaaatcagctatgccaacggtaacttcattcatgtcaacgaggaaccagtgactgcaagtaatatagaatttgaccaccttgccattctcttgcactcctttactatatctcatttatttcttatatacaaatcacttcttcttcccagcatcgagctcggaaacctcatgagcaataacatcgtggatctcgtcaatagagggctttttggactccttgctgttggccaccttgtccttgctgtttaaaccatcatctaagggcctcaaaactacctcggaactgctgcgctgatctggacaccacagaggttccgagcactttaggttgcaccaaatgtcccaccaggtgcaggcagaaaacgctggaacagcgtgtacagtttgtcttaacaaaaagtgagggcgctgaggtcgagcagggtggtgtgacttgttatagcctttagagctgcgaaagcgcgtatggatttggctcatcaggccagattgagggtctgtggacacatgtcatgttagtgtacttcaatcgccccctggatatagccccgacaataggccgtggcctcatttttttgccttccgcacatttccattgctcggtacccacaccttgcttctcctgcacttgccaaccttaatactggtttacattgaccaacatcttacaagcggggggcttgtctagggtatatataaacagtggctctcccaatcggttgccagtctcttttttcctttctttccccacagattcgaaatctaaactacacatcacaccatggtctccaaccacctgttcgacgccatgcgagctgccgctcccggagacgcacctttcattcgaatcgacaacgctcggacctggacttacgatgacgccattgctctttccggtcgaatcgctggagctatggacgcactcggcattcgacccggagacagagttgccgtgcaggtcgagaagtctgccgaggcgttgattctctacctggcctgtcttcgaaccggagctgtctacctgcctctcaacactgcctacaccctggccgagctcgactacttcatcggcgatgccgaaccgcgtctggtggtcgttgctcccgcagctcgaggtggcgtggagacaattgccaagcgacacggtgctatcgtcgaaaccctcgacgccgatggacgaggctccttgctggaccttgctagagatgagcctgccgactttgtcgatgcttcgcgatctgccgacgatctggctgctattctctacacttccggtacaaccggacgatcgaagggtgccatgcttactcatggcaatctgctctccaacgctctcaccttgcgagactattggagagttaccgcagacgatcgactcatccatgccttgccaatctttcacactcatggtctgttcgttgctacgaacgtcacactgcttgcaggagcctcgatgtttctgctctccaagttcgatgccgacgaggtcgtttctctcatgccacaggccaccatgcttatgggcgtgcccacattctacgttcgattgctgcagagtcctcgactcgagaagggtgctgtggccagcatcagactgttcatttctggatcagctcccttgcttgccgaaacccacgccgagtttcatgctcgtactggtcacgccattctcgagcgatacggcatgacggaaaccaacatgaatacttccaacccctacgagggcaagcgtattgccggaaccgttggttttcctctgcccgacgtcactgtgcgagtcaccgatcccgccaccggtctcgttcttccacctgaagagactggcatgatcgagatcaagggacccaacgtcttcaagggctattggcgaatgcccgaaaagaccgctgccgagtttaccgcagacggtttctttatctctggagatctcggcaagatcgaccgagaaggttacgttcacattgtgggacgaggcaaggacctggtcatttccggtggctacaacatctatcccaaagaggtcgaaggcgagatcgaccagatcgagggtgtggtcgagtctgctgtcattggtgttcctcatcccgatttcggagaaggtgtcaccgctgttgtcgtgtgcaaacctggtgccgttctcgacgaaaagaccatcgtgtctgctctgcaggaccgtcttgcccgatacaagcaacccaagcggattatctttgccgacgatctgcctcgaaacactatgggaaaggttcagaagaacattcttcgacagcaatacgccgatctctacaccagacgataagcggccgcatgagaagataaatatataaatacattgagatattaaatgcgctagattagagagcctcatactgctcggagagaagccaagacgagtactcaaaggggattacaccatccatatccacagacacaagctggggaaaggttctatatacactttccggaataccgtagtttccgatgttatcaatgggggcagccaggatttcaggcacttcggtgtctcggggtgaaatggcgttcttggcctccatcaagtcgtaccatgtcttcatttgcctgtcaaagtaaaacagaagcagatgaagaatgaacttgaagtgaaggaatttaaatagttggagcaagggagaaatgtagagtgtgaaagactcactatggtccgggcttatctcgaccaatagccaaagtctggagtttctgagagaaaaaggcaagatacgtatgtaacaaagcgacgcatggtacaataataccggaggcatgtatcatagagagttagtggttcgatgatggcactggtgcctggtatgactttatacggctgactacatatttgtcctcagacatacaattacagtcaagcacttacccttggacatctgtaggtaccccccggccaagacgatctcagcgtgtcgtatgtcggattggcgtagctccctcgctcgtcaattggctcccatctactttcttctgcttggctacacccagcatgtctgctatggctcgttttcgtgccttatctatcctcccagtattaccaactctaaatgacatgatgtgattgggtctacactttcatatcagagataaggagtagcacagttgcataaaaagcccaactctaatcagcttcttcctttcttgtaattagtacaaaggtgattagcgaaatctggaagcttagttggccctaaaaaaatcaaaaaaagcaaaaaacgaaaaacgaaaaaccacagttttgagaacagggaggtaacgaaggatcgtatatatatatatatatatatatacccacggatcccgagaccggcctttgattcttccctacaaccaaccattctcaccaccctaattcacaaccatggtgaaggcttctcgacaggctctgcccctcgtcatcgacggaaaggtgtacgacgtctccgcttgggtgaacttccaccctggtggagctgaaatcattgagaactaccagggacgagatgctactgacgccttcatggttatgcactctcaggaagccttcgacaagctcaagcgaatgcccaagatcaaccaggcttccgagctgcctccccaggctgccgtcaacgaagctcaggaggatttccgaaagctccgagaagagctgatcgccactggcatgtttgacgcctctcccctctggtactcgtacaagatcttgaccaccctgggtcttggcgtgcttgccttcttcatgctggtccagtaccacctgtacttcattggtgctctcgtgctcggtatgcactaccagcaaatgggatggctgtctcatgacatctgccaccaccagaccttcaagaaccgaaactggaataacgtcctgggtctggtctttggcaacggactccagggcttctccgtgacctggtggaaggacagacacaacgcccatcattctgctaccaacgttcagggtcacgatcccgacattgataacctgcctctgctcgcctggtccgaggacgatgtcactcgagcttctcccatctcccgaaagctcattcagttccaacagtactatttcctggtcatctgtattctcctgcgattcatctggtgtttccagtctgtgctgaccgttcgatccctcaaggaccgagacaaccagttctaccgatctcagtacaagaaagaggccattggactcgctctgcactggactctcaagaccctgttccacctcttctttatgccctccatcctgacctcgatgctggtgttctttgtttccgagctcgtcggtggcttcggaattgccatcgtggtcttcatgaaccactaccctctggagaagatcggtgattccgtctgggacggacatggcttctctgtgggtcagatccatgagaccatgaacattcgacgaggcatcattactgactggttctttggaggcctgaactaccagatcgagcaccatctctggcccaccctgcctcgacacaacctcactgccgtttcctaccaggtggaacagctgtgccagaagcacaacctcccctaccgaaaccctctgccccatgaaggtctcgtcatcctgctccgatacctgtcccagttcgctcgaatggccgagaagcagcccggtgccaaggctcagtaagcggccgcaagtgtggatggggaagtgagtgcccggttctgtgtgcacaattggcaatccaagatggatggattcaacacagggatatagcgagctacgtggtggtgcgaggatatagcaacggatatttatgtttgacacttgagaatgtacgatacaagcactgtccaagtacaatactaaacatactgtacatactcatactcgtacccgggcaacggtttcacttgagtgcagtggctagtgctcttactcgtacagtgtgcaatactgcgtatcatagtctttgatgtatatcgtattcattcatgttagttgc

SEQ ID NO: 86 - DNA, 15181 bp, Artificial Sequence
  Plasmid pZK16-MyL8N
aaaccatcatctaagggcctcaaaactacctcggaactgctgcgctgatctggacaccacagaggttccgagcactttaggttgcaccaaatgtcccaccaggtgcaggcagaaaacgctggaacagcgtgtacagtttgtcttaacaaaaagtgagggcgctgaggtcgagcagggtggtgtgacttgttatagcctttagagctgcgaaagcgcgtatggatttggctcatcaggccagattgagggtctgtggacacatgtcatgttagtgtacttcaatcgccccctggatatagccccgacaataggccgtggcctcatttttttgccttccgcacatttccattgctcggtacccacaccttgcttctcctgcacttgccaaccttaatactggtttacattgaccaacatcttacaagcggggggcttgtctagggtatatataaacagtggctctcccaatcggttgccagtctcttttttcctttctttccccacagattcgaaatctaaactacacatcacaccatggtctccaaccacctgttcgacgccatgcgagctgccgctcccggagacgcacctttcattcgaatcgacaacgctcggacctggacttacgatgacgccattgctctttccggtcgaatcgctggagctatggacgcactcggcattcgacccggagacagagttgccgtgcaggtcgagaagtctgccgaggcgttgattctctacctggcctgtcttcgaaccggagctgtctacctgcctctcaacactgcctacaccctggccgagctcgactacttcatcggcgatgccgaaccgcgtctggtggtcgttgctcccgcagctcgaggtggcgtggagacaattgccaagcgacacggtgctatcgtcgaaaccctcgacgccgatggacgaggctccttgctggaccttgctagagatgagcctgccgactttgtcgatgcttcgcgatctgccgacgatctggctgctattctctacacttccggtacaaccggacgatcgaagggtgccatgcttactcatggcaatctgctctccaacgctctcaccttgcgagactattggagagttaccgcagacgatcgactcatccatgccttgccaatctttcacactcatggtctgttcgttgctacgaacgtcacactgcttgcaggagcctcgatgtttctgctctccaagttcgatgccgacgaggtcgtttctctcatgccacaggccaccatgcttatgggcgtgcccacattctacgttcgattgctgcagagtcctcgactcgagaagggtgctgtggccagcatcagactgttcatttctggatcagctcccttgcttgccgaaacccacgccgagtttcatgctcgtactggtcacgccattctcgagcgatacggcatgacggaaaccaacatgaatacttccaacccctacgagggcaagcgtattgccggaaccgttggttttcctctgcccgacgtcactgtgcgagtcaccgatcccgccaccggtctcgttcttccacctgaagagactggcatgatcgagatcaagggacccaacgtcttcaagggctattggcgaatgcccgaaaagaccgctgccgagtttaccgcagacggtttctttatctctggagatctcggcaagatcgaccgagaaggttacgttcacattgtgggacgaggcaaggacctggtcatttccggtggctacaacatctatcccaaagaggtcgaaggcgagatcgaccagatcgagggtgtggtcgagtctgctgtcattggtgttcctcatcccgatttcggagaaggtgtcaccgctgttgtcgtgtgcaaacctggtgccgttctcgacgaaaagaccatcgtgtctgctctgcaggaccgtcttgcccgatacaagcaacccaagcggattatctttgccgacgatctgcctcgaaacactatgggaaaggttcagaagaacattcttcgacagcaatacgccgatctctacaccagacgataagcggccgcatgagaagataaatatataaatacattgagatattaaatgcgctagattagagagcctcatactgctcggagagaagccaagacgagtactcaaaggggattacaccatccatatccacagacacaagctggggaaaggttctatatacactttccggaataccgtagtttccgatgttatcaatgggggcagccaggatttcaggcacttcggtgtctcggggtgaaatggcgttcttggcctccatcaagtcgtaccatgtcttcatttgcctgtcaaagtaaaacagaagcagatgaagaatgaacttgaagtgaaggaatttaaatagttggagcaagggagaaatgtagagtgtgaaagactcactatggtccgggcttatctcgaccaatagccaaagtctggagtttctgagagaaaaaggcaagatacgtatgtaacaaagcgacgcatggtacaataataccggaggcatgtatcatagagagttagtggttcgatgatggcactggtgcctggtatgactttatacggctgactacatatttgtcctcagacatacaattacagtcaagcacttacccttggacatctgtaggtaccccccggccaagacgatctcagcgtgtcgtatgtcggattggcgtagctccctcgctcgtcaattggctcccatctactttcttctgcttggctacacccagcatgtctgctatggctcgttttcgtgccttatctatcctcccagtattaccaactctaaatgacatgatgtgattgggtctacactttcatatcagagataaggagtagcacagttgcataaaaagcccaactctaatcagcttcttcctttcttgtaattagtacaaaggtgattagcgaaatctggaagcttagttggccctaaaaaaatcaaaaaaagcaaaaaacgaaaaacgaaaaaccacagttttgagaacagggaggtaacgaaggatcgtatatatatatatatatatatatacccacggatcccgagaccggcctttgattcttccctacaaccaaccattctcaccaccctaattcacaaccatggtgaaggcttctcgacaggctctgcccctcgtcatcgacggaaaggtgtacgacgtctccgcttgggtgaacttccaccctggtggagctgaaatcattgagaactaccagggacgagatgctactgacgccttcatggttatgcactctcaggaagccttcgacaagctcaagcgaatgcccaagatcaaccaggcttccgagctgcctccccaggctgccgtcaacgaagctcaggaggatttccgaaagctccgagaagagctgatcgccactggcatgtttgacgcctctcccctctggtactcgtacaagatcttgaccaccctgggtcttggcgtgcttgccttcttcatgctggtccagtaccacctgtacttcattggtgctctcgtgctcggtatgcactaccagcaaatgggatggctgtctcatgacatctgccaccaccagaccttcaagaaccgaaactggaataacgtcctgggtctggtctttggcaacggactccagggcttctccgtgacctggtggaaggacagacacaacgcccatcattctgctaccaacgttcagggtcacgatcccgacattgataacctgcctctgctcgcctggtccgaggacgatgtcactcgagcttctcccatctcccgaaagctcattcagttccaacagtactatttcctggtcatctgtattctcctgcgattcatctggtgtttccagtctgtgctgaccgttcgatccctcaaggaccgagacaaccagttctaccgatctcagtacaagaaagaggccattggactcgctctgcactggactctcaagaccctgttccacctcttctttatgccctccatcctgacctcgatgctggtgttctttgtttccgagctcgtcggtggcttcggaattgccatcgtggtcttcatgaaccactaccctctggagaagatcggtgattccgtctgggacggacatggcttctctgtgggtcagatccatgagaccatgaacattcgacgaggcatcattactgactggttctttggaggcctgaactaccagatcgagcaccatctctggcccaccctgcctcgacacaacctcactgccgtttcctaccaggtggaacagctgtgccagaagcacaacctcccctaccgaaaccctctgccccatgaaggtctcgtcatcctgctccgatacctgtcccagttcgctcgaatggccgagaagcagcccggtgccaaggctcagtaagcggccgcaagtgtggatggggaagtgagtgcccggttctgtgtgcacaattggcaatccaagatggatggattcaacacagggatatagcgagctacgtggtggtgcgaggatatagcaacggatatttatgtttgacacttgagaatgtacgatacaagcactgtccaagtacaatactaaacatactgtacatactcatactcgtacccgggcaacggtttcacttgagtgcagtggctagtgctcttactcgtacagtgtgcaatactgcgtatcatagtctttgatgtatatcgtattcattcatgttagttgcgtacgcattcttgacttgctccccagttgccctttttggtcataactcagccccgactctctccccaaagaggagatggacttacaatagatacgagacaacagatattttcggccacctggtgcaattggtctgttttattacccccaataatatccacagcgtccgaatcagctcgacaagctctttctcagcatactgatcttaccccataccccccagacagcggtgccatatccatacccgcactacctgagacagtaaactcagggcaaggagcggtcttggtccatcgcgacgctgtaagctttgcctttgcgttttgtgatccaccacacggcagtcaaggtctcggttgaaagatgggtctggcaatgtggattgctgaatcattgacatataaatacgagtgatcctgccatttcccaatctttagaaatcatcttttcttcacacatacaaaaaacacacatcacaatgcagttctccgccgccgccgtccttgccctcgccgccttcgtctctgcccaggccgcctccgctgcttctgaagctggtggtgccgttgtctccggtgcctccggtgccgctgccgccgcttcttctgctgtcattggctccgagtctcaggccgcttcttctgctgcctcttctgctgctgagtctgcttcttccgctgcctctgagtccgcctcctccgcttccgcctccgagtccaaggcctctgagtccgcttccaagtccgcctccaaggcttctgagtctgcttccaaggccgagtcttctgctgccaaggcttcctccgctgctggttctgcttcttccgccgctgcctctgccaccaagtctggtgatgcctccggctcttccaagccttccggctctgcctcctctaccggtgacaagtccggtgctggtattgttgcccccgctgttggtgccatcgttgtcggtgctcttgctcagctcatctaagcggtctttgtacaactacccacttaatatttatattatgatatagactgcaatactattgcatgtgtaatgcttcgtttgaaagtcgtagtccggccattcatggcagtgtatggcagtattgcaaccaattggcttaataacatatacaaagtggcaattctgtgttcgaaccatcacacaacccaacatatttgacattgctacaagtattcgacttgttcttcggccgcacgacatgcattgctagcagcacacttgcagaagcttggccaatggttaggttgacctttaaccagtaaaacgcaatataggttgccaattaacaaacaacacagcccagaactggtgtaaagggcttgggttttgtgcaatcaactcattgactcacctcccccaatgctccatgaacccatgaatccatagtacctccatcccaattcagagaggctcagaaacacgcaattggcaaaagtaaacaaaggtctcgaaaccttaaggggtgcagtgttgcaaagttaaaattacactgttggatggtgttccactcaaactgtggatggatcagacggttgcactaaaccaagattcaatatgctctacaagtagcgtgccatgaggtgtataatatcacacatgatcagagttaaggcctggaaaaaaagtgtccgcggctatgtaacactgctgaatacagtgtgtgccgtttccacggactggaatgaatgcactcaacacgttggtagctaacttccccaactattgacttcactttactgtagctactctaagtacgataatgacatcatgaatcaccaactttatcttccccaccgaaagtaagagatgaaagagaggctaacagcttttgtaagaaaatcacaaaatctacttaccgtattacaaaagtacaagtatcagtaaccaggcgcgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgatgcggtgtgaaataccgcacagatgcgtaaggagaaaataccgcatcaggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggcccgacgtcgcatgctatgtacactgtgtgagtgtagagggcaatggtggtgacaactgagctactatacacacacagcttgtactggtataagttgtgagctacagtacaagtaatactacaaaattcagtatgtacaagtatgccggtacggcagtagcatgtatcaaagagagacagaaagaaggctggaaagcgaaggccagctgagcgtgggaaccgcagtacgtggaagtgccaaacctgcgacagaatgacatggtcttgcactttttaccggtaccggtacagtacgataccggtacgcacttgctacagtagatcatagaccaccagaataaccctgcattagcgccacgttgccaagccctcaactttctttgcagctacaccttttacaccttttaggctgccaggaagagcataaatgaattgtacttgggggcacagaatttgggttgaagtgttcctgggagagaatgtgcttggctgtatagttgggtggctctccttcatagtagatgtgaggttacagcacttgtagattgtgtacgcgttctgtttaaggtggtaccagtattatgggttgacgtgaaagaaagggaggaggcaggggtacagcaagagtgtgggcgcacactcacacatgaagcaagacctgtttcgtcatttctatttgtttaacaaggacgacataatatacttaggacagcatgggccgaccggcaggaataatctgcaaacacaatcgtattgtggcgtcccctctcgatcacgatagttgctaagtttagcagtctgagagtttggctgtgacgcaagaccgagagagagacagagagttgtcccagtttgagtactcgtaccgtactacagagtaaatcgaaatcgagcgctcactttctgcactttgtgaaggcgcagcattcaacatttgtgtccagcccctttccgtttgaagcgacttgaccacgaaatgttggaataaagctgtgttacatacgagacctacaagtagagtgtcggatatgccaactgaacaggttagatgaaagttactcaacaacaggagagcggacaccaacgtgcgaaaatgtacggatgaacccattgtctgtccgcatagcaatctgttttcgccagcagtgcttgtgtcgttggattgctgccattgtactatttgtactttgttccattaacactcgcatcttgctcaccgattagcagcactcctgttgcctcactgggcttgtctgtttcagggtggaatgcatgagcaatgcgatcgtcaaggggaggttgaaagcgcgtatggaataactgtggttctatagctgaggggaggatatcgaggacagccacggttcagtgggggatttcgggagctactcagtaacatgtactcttgtccgaacgccctgctgatggcaaatatgacaaaacgcaacaatgtggagcaacatttccatttcgagagatattacatgggttgcattggggcctgggcatcccgtgcaataaccgagaccatgtgaaggtgcacgatcgacacttatccagccagtcatacgtggtgtcgcaagctaagcaacaatgggattcacgaatctatgtgggggaacgtgcacaggggaaatgaaacaaaacggaggagggggtctttgaaaatgtagagaaatataacaaaaaatcacaaaaacgcaccaaaaatatgccaaaatcgtcaacagtggaaatcacgcgcccctggctcgacttcccactgacataccccccctcaaccaatatcatatccaccctagccaatcgcttaattaagttgcgacacatgtcttgatagtatcttgaattctctctcttgagcttttccataacaagttcttctgcctccaggaagtccatgggtggtttgatcatggttttggtgtagtggtagtgcagtggtggtattgtgactggggatgtagttgagaataagtcatacacaagtcagctttcttcgagcctcatataagtataagtagttcaacgtattagcactgtacccagcatctccgtatcgagaaacacaacaacatgccccattggacagatcatgcggatacacaggttgtgcagtatcatacatactcgatcagacaggtcgtctgaccatcatacaagctgaacaagcgctccatacttgcacgctctctatatacacagttaaattacatatccatagtctaacctctaacagttaatcttctggtaagcctcccagccagccttctggtatcgcttggcctcctcaataggatctcggttctggccgtacagacctcggccgacaattatgatatccgttccggtagacatgacatcctcaacagttcggtactgctgtccgagagcgtctcccttgtcgtcaagacccaccccgggggtcagaataagccagtcctcagagtcgcccttaggtcggttctgggcaatgaagccaaccacaaactcggggtcggatcgggcaagctcaatggtctgcttggagtactcgccagtggccagagagcccttgcaagacagctcggccagcatgagcagacctctggccagcttctcgttgggagaggggactaggaactccttgtactgggagttctcgtagtcagagacgtcctccttcttctgttcagagacagtttcctcggcaccagctcgcaggccagcaatgattccggttccgggtacaccgtgggcgttggtgatatcggaccactcggcgattcggtgacaccggtactggtgcttgacagtgttgccaatatctgcgaactttctgtcctcgaacaggaagaaaccgtgcttaagagcaagttccttgagggggagcacagtgccggcgtaggtgaagtcgtcaatgatgtcgatatgggttttgatcatgcacacataaggtccgaccttatcggcaagctcaatgagctccttggtggtggtaacatccagagaagcacacaggttggttttcttggctgccacgagcttgagcactcgagcggcaaaggcggacttgtggacgttagctcgagcttcgtaggagggcattttggtggtgaagaggagactgaaataaatttagtctgcagaactttttatcggaaccttatctggggcagtgaagtatatgttatggtaatagttacgagttagttgaacttatagatagactggactatacggctatcggtccaaattagaaagaacgtcaatggctctctgggcgtcgcctttgccgacaaaaatgtgatcatgatgaaagccagcaatgacgttgcagctgatattgttgtcggccaaccgcgccgaaaacgcagctgtcagacccacagcctccaacgaagaatgtatcgtcaaagtgatccaagcacactcatagttggagtcgtactccaaaggcggcaatgacgagtcagacagatactcgtcgaccttttccttgggaaccaccaccgtcagcccttctgactcacgtattgtagccaccgacacaggcaacagtccgtggatagcagaatatgtcttgtcggtccatttctcaccaactttaggcgtcaagtgaatgttgcagaagaagtatgtgccttcattgagaatcggtgttgctgatttcaataaagtcttgagatcagtttggccagtcatgttgtggggggtaattggattgagttatcgcctacagtctgtacaggtatactcgctgcccactttatactttttgattccgctgcacttgaagcaatgtcgtttaccaaaagtgagaatgctccacagaacacaccccagggtatggttgagcaaaaaataaacactccgatacggggaatcgaaccccggtctccacggttctcaagaagtattcttgatgagagcgtatcgatagttggagcaagggagaaatgtagagtgtgaaagactcactatggtccgggcttatctcgaccaatagccaaagtctggagtttctgagagaaaaaggcaagatacgtatgtaacaaagcgacgcatggtacaataataccggaggcatgtatcatagagagttagtggttcgatgatggcactggtgcctggtatgactttatacggctgactacatatttgtcctcagacatacaattacagtcaagcacttacccttggacatctgtaggtaccccccggccaagacgatctcagcgtgtcgtatgtcggattggcgtagctccctcgctcgtcaattggctcccatctactttcttctgcttggctacacccagcatgtctgctatggctcgttttcgtgccttatctatcctcccagtattaccaactctaaatgacatgatgtgattgggtctacactttcatatcagagataaggagtagcacagttgcataaaaagcccaactctaatcagcttcttcctttcttgtaattagtacaaaggtgattagcgaaatctggaagcttagttggccctaaaaaaatcaaaaaaagcaaaaaacgaaaaacgaaaaaccacagttttgagaacagggaggtaacgaaggatcgtatatatatatatatatatatatacccacggatcccgagaccggcctttgattcttccctacaaccaaccattctcaccaccctaattcacaaccatgtccgttgcatccaagctcgtcttctacgtccgcgccgccatcgccgtggtcatctttgccgcctgtgccacctacggcgtgctggcgtccaccattctcaccgccatcggcaagcagggcctggcccaatggaccgttgccagagccttctactactcggtgcgcatcttcctgggtatcagcatcaagctgcgtagccggcaggtgaccggaaccgccggtctggatgcctccaagatccaggtcgccaacaccaccaagcccattgacgacatcaccaaacacctgccccgaccatgcattctgatttccaaccaccagaacgaaatggacattctggtgctcggtcgcatcttcccccagtactgctccgtcaccgccaaaaaggccctcaagtggtaccctctgctgggccagttcatggcgctgtccggcaccatcttcctggaccgaaaggaccgaaccaagtccgtgcagaccctcggcggcgccgtcaagaccatccagagcggcaacggaggcaagggccagagcgtcttcatgttccccgagggaacccgatcctactccaaggacgtcggcatcatgcccttcaagaagggctgtttccacctggcggtccagtcgggcgctcccattgtccccgtggtggtccagaacacctcccgaatgttttctttcggccgaggcaagctggacgccggagagatccttgtcgacgtcctgagccccattgagaccaagggtctggacgccagcaacgtcgacgctctcatggccaccacttataaggccatgtgcgagactgccgaccagattggctacgctggccagaagactcagtaggcggccgcatgagaagataaatatataaatacattgagatattaaatgcgctagattagagagcctcatactgctcggagagaagccaagacgagtactcaaaggggattacaccatccatatccacagacacaagctggggaaaggttctatatacactttccggaataccgtagtttccgatgttatcaatgggggcagccaggatttcaggcacttcggtgtctcggggtgaaatggcgttcttggcctccatcaagtcgtaccatgtcttcatttgcctgtcaaagtaaaacagaagcagatgaagaatgaacttgaagtgaaggaattt

SEQ ID NO: 87 - DNA, 1272 bp, Artificial Sequence
  mutant EgD8S-23 delta-8 desaturase (also "EgD8M")
  CDS (2)..(1270)
  ref <302>: TITLE: MUTANT DELTA-8 DESATURASE GENES ENGINEERED BY TARGETED MUTAGENSIS AND THEIR USE IN MAKING POLYUNSATURATED FATTY ACIDS
  ref <310>: PATENT DOCUMENT NUMBER: US 7709239
  ref <311>: PATENT FILING DATE: 2006-12-07
  ref <312>: PUBLICATION DATE: 2010-05-04
  ref <313>: RELEVANT RESIDUES IN SEQ ID NO: (1)..(1272)
catggtgaaggcttctcgacaggctctgcccctcgtcatcgacggaaaggtgtacgacgtctccgcttgggtgaacttccaccctggtggagctgaaatcattgagaactaccagggacgagatgctactgacgccttcatggttatgcactctcaggaagccttcgacaagctcaagcgaatgcccaagatcaaccaggcttccgagctgcctccccaggctgccgtcaacgaagctcaggaggatttccgaaagctccgagaagagctgatcgccactggcatgtttgacgcctctcccctctggtactcgtacaagatcttgaccaccctgggtcttggcgtgcttgccttcttcatgctggtccagtaccacctgtacttcattggtgctctcgtgctcggtatgcactaccagcaaatgggatggctgtctcatgacatctgccaccaccagaccttcaagaaccgaaactggaataacgtcctgggtctggtctttggcaacggactccagggcttctccgtgacctggtggaaggacagacacaacgcccatcattctgctaccaacgttcagggtcacgatcccgacattgataacctgcctctgctcgcctggtccgaggacgatgtcactcgagcttctcccatctcccgaaagctcattcagttccaacagtactatttcctggtcatctgtattctcctgcgattcatctggtgtttccagtctgtgctgaccgttcgatccctcaaggaccgagacaaccagttctaccgatctcagtacaagaaagaggccattggactcgctctgcactggactctcaagaccctgttccacctcttctttatgccctccatcctgacctcgatgctggtgttctttgtttccgagctcgtcggtggcttcggaattgccatcgtggtcttcatgaaccactaccctctggagaagatcggtgattccgtctgggacggacatggcttctctgtgggtcagatccatgagaccatgaacattcgacgaggcatcattactgactggttctttggaggcctgaactaccagatcgagcaccatctctggcccaccctgcctcgacacaacctcactgccgtttcctaccaggtggaacagctgtgccagaagcacaacctcccctaccgaaaccctctgccccatgaaggtctcgtcatcctgctccgatacctgtcccagttcgctcgaatggccgagaagcagcccggtgccaaggctcagtaagc

SEQ ID NO: 88 - protein, 422 aa, Artificial Sequence
  Synthetic Construct
MVKASRQALPLVIDGKVYDVSAWVNFHPGGAEIIENYQGRDATDAFMVMHSQEAFDKLKRMPKINQASELPPQAAVNEAQEDFRKLREELIATGMFDASPLWYSYKILTTLGLGVLAFFMLVQYHLYFIGALVLGMHYQQMGWLSHDICHHQTFKNRNWNNVLGLVFGNGLQGFSVTWWKDRHNAHHSATNVQGHDPDIDNLPLLAWSEDDVTRASPISRKLIQFQQYYFLVICILLRFIWCFQSVLTVRSLKDRDNQFYRSQYKKEAIGLALHWTLKTLFHLFFMPSILTSMLVFFVSELVGGFGIAIVVFMNHYPLEKIGDSVWDGHGFSVGQIHETMNIRRGIITDWFFGGLNYQIEHHLWPTLPRHNLTAVSYQVEQLCQKHNLPYRNPLPHEGLVILLRYLSQFARMAEKQPGAKAQ

SEQ ID NO: 89 - DNA, 15105 bp, Artificial Sequence
  Plasmid pZK16-ML3
gtacgcattcttgacttgctccccagttgccctttttggtcataactcagccccgactctctccccaaagaggagatggacttacaatagatacgagacaacagatattttcggccacctggtgcaattggtctgttttattacccccaataatatccacagcgtccgaatcagctcgacaagctctttctcagcatactgatcttaccccataccccccagacagcggtgccatatccatacccgcactacctgagacagtaaactcagggcaaggagcggtcttggtccatcgcgacgctgtaagctttgcctttgcgttttgtgatccaccacacggcagtcaaggtctcggttgaaagatgggtctggcaatgtggattgctgaatcattgacatataaatacgagtgatcctgccatttcccaatctttagaaatcatcttttcttcacacatacaaaaaacacacatcacaatgcagttctccgccgccgccgtccttgccctcgccgccttcgtctctgcccaggccgcctccgctgcttctgaagctggtggtgccgttgtctccggtgcctccggtgccgctgccgccgcttcttctgctgtcattggctccgagtctcaggccgcttcttctgctgcctcttctgctgctgagtctgcttcttccgctgcctctgagtccgcctcctccgcttccgcctccgagtccaaggcctctgagtccgcttccaagtccgcctccaaggcttctgagtctgcttccaaggccgagtcttctgctgccaaggcttcctccgctgctggttctgcttcttccgccgctgcctctgccaccaagtctggtgatgcctccggctcttccaagccttccggctctgcctcctctaccggtgacaagtccggtgctggtattgttgcccccgctgttggtgccatcgttgtcggtgctcttgctcagctcatctaagcggtctttgtacaactacccacttaatatttatattatgatatagactgcaatactattgcatgtgtaatgcttcgtttgaaagtcgtagtccggccattcatggcagtgtatggcagtattgcaaccaattggcttaataacatatacaaagtggcaattctgtgttcgaaccatcacacaacccaacatatttgacattgctacaagtattcgacttgttcttcggccgcacgacatgcattgctagcagcacacttgcagaagcttggccaatggttaggttgacctttaaccagtaaaacgcaatataggttgccaattaacaaacaacacagcccagaactggtgtaaagggcttgggttttgtgcaatcaactcattgactcacctcccccaatgctccatgaacccatgaatccatagtacctccatcccaattcagagaggctcagaaacacgcaattggcaaaagtaaacaaaggtctcgaaaccttaaggggtgcagtgttgcaaagttaaaattacactgttggatggtgttccactcaaactgtggatggatcagacggttgcactaaaccaagattcaatatgctctacaagtagcgtgccatgaggtgtataatatcacacatgatcagagttaaggcctggaaaaaaagtgtccgcggctatgtaacactgctgaatacagtgtgtgccgtttccacggactggaatgaatgcactcaacacgttggtagctaacttccccaactattgacttcactttactgtagctactctaagtacgataatgacatcatgaatcaccaactttatcttccccaccgaaagtaagagatgaaagagaggctaacagcttttgtaagaaaatcacaaaatctacttaccgtattacaaaagtacaagtatcagtaaccaggcgcgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgatgcggtgtgaaataccgcacagatgcgtaaggagaaaataccgcatcaggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggcccgacgtcgcatgctatgtacactgtgtgagtgtagagggcaatggtggtgacaactgagctactatacacacacagcttgtactggtataagttgtgagctacagtacaagtaatactacaaaattcagtatgtacaagtatgccggtacggcagtagcatgtatcaaagagagacagaaagaaggctggaaagcgaaggccagctgagcgtgggaaccgcagtacgtggaagtgccaaacctgcgacagaatgacatggtcttgcactttttaccggtaccggtacagtacgataccggtacgcacttgctacagtagatcatagaccaccagaataaccctgcattagcgccacgttgccaagccctcaactttctttgcagctacaccttttacaccttttaggctgccaggaagagcataaatgaattgtacttgggggcacagaatttgggttgaagtgttcctgggagagaatgtgcttggctgtatagttgggtggctctccttcatagtagatgtgaggttacagcacttgtagattgtgtacgcgttctgtttaaggtggtaccagtattatgggttgacgtgaaagaaagggaggaggcaggggtacagcaagagtgtgggcgcacactcacacatgaagcaagacctgtttcgtcatttctatttgtttaacaaggacgacataatatacttaggacagcatgggccgaccggcaggaataatctgcaaacacaatcgtattgtggcgtcccctctcgatcacgatagttgctaagtttagcagtctgagagtttggctgtgacgcaagaccgagagagagacagagagttgtcccagtttgagtactcgtaccgtactacagagtaaatcgaaatcgagcgctcactttctgcactttgtgaaggcgcagcattcaacatttgtgtccagcccctttccgtttgaagcgacttgaccacgaaatgttggaataaagctgtgttacatacgagacctacaagtagagtgtcggatatgccaactgaacaggttagatgaaagttactcaacaacaggagagcggacaccaacgtgcgaaaatgtacggatgaacccattgtctgtccgcatagcaatctgttttcgccagcagtgcttgtgtcgttggattgctgccattgtactatttgtactttgttccattaacactcgcatcttgctcaccgattagcagcactcctgttgcctcactgggcttgtctgtttcagggtggaatgcatgagcaatgcgatcgtcaaggggaggttgaaagcgcgtatggaataactgtggttctatagctgaggggaggatatcgaggacagccacggttcagtgggggatttcgggagctactcagtaacatgtactcttgtccgaacgccctgctgatggcaaatatgacaaaacgcaacaatgtggagcaacatttccatttcgagagatattacatgggttgcattggggcctgggcatcccgtgcaataaccgagaccatgtgaaggtgcacgatcgacacttatccagccagtcatacgtggtgtcgcaagctaagcaacaatgggattcacgaatctatgtgggggaacgtgcacaggggaaatgaaacaaaacggaggagggggtctttgaaaatgtagagaaatataacaaaaaatcacaaaaacgcaccaaaaatatgccaaaatcgtcaacagtggaaatcacgcgcccctggctcgacttcccactgacataccccccctcaaccaatatcatatccaccctagccaatcgcttaattaagttgcgacacatgtcttgatagtatcttgaattctctctcttgagcttttccataacaagttcttctgcctccaggaagtccatgggtggtttgatcatggttttggtgtagtggtagtgcagtggtggtattgtgactggggatgtagttgagaataagtcatacacaagtcagctttcttcgagcctcatataagtataagtagttcaacgtattagcactgtacccagcatctccgtatcgagaaacacaacaacatgccccattggacagatcatgcggatacacaggttgtgcagtatcatacatactcgatcagacaggtcgtctgaccatcatacaagctgaacaagcgctccatacttgcacgctctctatatacacagttaaattacatatccatagtctaacctctaacagttaatcttctggtaagcctcccagccagccttctggtatcgcttggcctcctcaataggatctcggttctggccgtacagacctcggccgacaattatgatatccgttccggtagacatgacatcctcaacagttcggtactgctgtccgagagcgtctcccttgtcgtcaagacccaccccgggggtcagaataagccagtcctcagagtcgcccttaggtcggttctgggcaatgaagccaaccacaaactcggggtcggatcgggcaagctcaatggtctgcttggagtactcgccagtggccagagagcccttgcaagacagctcggccagcatgagcagacctctggccagcttctcgttgggagaggggactaggaactccttgtactgggagttctcgtagtcagagacgtcctccttcttctgttcagagacagtttcctcggcaccagctcgcaggccagcaatgattccggttccgggtacaccgtgggcgttggtgatatcggaccactcggcgattcggtgacaccggtactggtgcttgacagtgttgccaatatctgcgaactttctgtcctcgaacaggaagaaaccgtgcttaagagcaagttccttgagggggagcacagtgccggcgtaggtgaagtcgtcaatgatgtcgatatgggttttgatcatgcacacataaggtccgaccttatcggcaagctcaatgagctccttggtggtggtaacatccagagaagcacacaggttggttttcttggctgccacgagcttgagcactcgagcggcaaaggcggacttgtggacgttagctcgagcttcgtaggagggcattttggtggtgaagaggagactgaaataaatttagtctgcagaactttttatcggaaccttatctggggcagtgaagtatatgttatggtaatagttacgagttagttgaacttatagatagactggactatacggctatcggtccaaattagaaagaacgtcaatggctctctgggcgtcgcctttgccgacaaaaatgtgatcatgatgaaagccagcaatgacgttgcagctgatattgttgtcggccaaccgcgccgaaaacgcagctgtcagacccacagcctccaacgaagaatgtatcgtcaaagtgatccaagcacactcatagttggagtcgtactccaaaggcggcaatgacgagtcagacagatactcgtcgaccttttccttgggaaccaccaccgtcagcccttctgactcacgtattgtagccaccgacacaggcaacagtccgtggatagcagaatatgtcttgtcggtccatttctcaccaactttaggcgtcaagtgaatgttgcagaagaagtatgtgccttcattgagaatcggtgttgctgatttcaataaagtcttgagatcagtttggccagtcatgttgtggggggtaattggattgagttatcgcctacagtctgtacaggtatactcgctgcccactttatactttttgattccgctgcacttgaagcaatgtcgtttaccaaaagtgagaatgctccacagaacacaccccagggtatggttgagcaaaaaataaacactccgatacggggaatcgaaccccggtctccacggttctcaagaagtattcttgatgagagcgtatcgatagttggagcaagggagaaatgtagagtgtgaaagactcactatggtccgggcttatctcgaccaatagccaaagtctggagtttctgagagaaaaaggcaagatacgtatgtaacaaagcgacgcatggtacaataataccggaggcatgtatcatagagagttagtggttcgatgatggcactggtgcctggtatgactttatacggctgactacatatttgtcctcagacatacaattacagtcaagcacttacccttggacatctgtaggtaccccccggccaagacgatctcagcgtgtcgtatgtcggattggcgtagctccctcgctcgtcaattggctcccatctactttcttctgcttggctacacccagcatgtctgctatggctcgttttcgtgccttatctatcctcccagtattaccaactctaaatgacatgatgtgattgggtctacactttcatatcagagataaggagtagcacagttgcataaaaagcccaactctaatcagcttcttcctttcttgtaattagtacaaaggtgattagcgaaatctggaagcttagttggccctaaaaaaatcaaaaaaagcaaaaaacgaaaaacgaaaaaccacagttttgagaacagggaggtaacgaaggatcgtatatatatatatatatatatatacccacggatcccgagaccggcctttgattcttccctacaaccaaccattctcaccaccctaattcacaaccatgtctattggttcgtccaaccccgtgctcttggctgcgattcccttcgtctacctgtttgtcctcccacgagtcctggctttcctgcctcagaaggctcagttcctggccaaatgtattgtggtcctgattgccacgcttatcatgtccgttgcaggctgcttcatctcgatcgtgtgcgctcttctggacaagagatacgtcatcaattacgttgtgtcgcgattgttctccttccttgccgctcgaccgtgtggtgtgacctataagattgttggtgaggaacacctcgataagtaccctgctatcgtggtctgtaaccatcaatcctctatggatatgatggttttgggacgagtttttccaaagcactgcgttgtcatggcgaagaaggaactcctgtactttccctttttgggaatgtttatgaaactgagcaacgctatcttcatcgaccggaagaaccacaagaaagccatcgagtctaccacccaagccgtggcggacatgaagaagcacaactctggaatctggattttcccagagggcacccggtctagactggacaaggcagacctgctgcccttcaagaaaggtgcctttcatcttgcaattcaggcccagctccctattctccccattatctcgcagggctattcccatatctacgactcttcgaagcggtacttccccggtggagagctcgagatcagagtcctggagcccattcctacaactggcctcactactgatgatgtgaacgacctgatggacaagacacgaaaccttatgctcaagcacttgaaggagatggattcccagtattcgtcgagcactgctgaaaatggatccacgcacatcgacgccgatattgccaagtctacagccaccagcattggcaacactgacgacgcaattacaaaacgtcgtacccctaaggaataagcggccgcattgatgattggaaacacacacatgggttatatctaggtgagagttagttggacagttatatattaaatcagctatgccaacggtaacttcattcatgtcaacgaggaaccagtgactgcaagtaatatagaatttgaccaccttgccattctcttgcactcctttactatatctcatttatttcttatatacaaatcacttcttcttcccagcatcgagctcggaaacctcatgagcaataacatcgtggatctcgtcaatagagggctttttggactccttgctgttggccaccttgtccttgctgtttaaaccatcatctaagggcctcaaaactacctcggaactgctgcgctgatctggacaccacagaggttccgagcactttaggttgcaccaaatgtcccaccaggtgcaggcagaaaacgctggaacagcgtgtacagtttgtcttaacaaaaagtgagggcgctgaggtcgagcagggtggtgtgacttgttatagcctttagagctgcgaaagcgcgtatggatttggctcatcaggccagattgagggtctgtggacacatgtcatgttagtgtacttcaatcgccccctggatatagccccgacaataggccgtggcctcatttttttgccttccgcacatttccattgctcggtacccacaccttgcttctcctgcacttgccaaccttaatactggtttacattgaccaacatcttacaagcggggggcttgtctagggtatatataaacagtggctctcccaatcggttgccagtctcttttttcctttctttccccacagattcgaaatctaaactacacatcacaccatggtctccaaccacctgttcgacgccatgcgagctgccgctcccggagacgcacctttcattcgaatcgacaacgctcggacctggacttacgatgacgccattgctctttccggtcgaatcgctggagctatggacgcactcggcattcgacccggagacagagttgccgtgcaggtcgagaagtctgccgaggcgttgattctctacctggcctgtcttcgaaccggagctgtctacctgcctctcaacactgcctacaccctggccgagctcgactacttcatcggcgatgccgaaccgcgtctggtggtcgttgctcccgcagctcgaggtggcgtggagacaattgccaagcgacacggtgctatcgtcgaaaccctcgacgccgatggacgaggctccttgctggaccttgctagagatgagcctgccgactttgtcgatgcttcgcgatctgccgacgatctggctgctattctctacacttccggtacaaccggacgatcgaagggtgccatgcttactcatggcaatctgctctccaacgctctcaccttgcgagactattggagagttaccgcagacgatcgactcatccatgccttgccaatctttcacactcatggtctgttcgttgctacgaacgtcacactgcttgcaggagcctcgatgtttctgctctccaagttcgatgccgacgaggtcgtttctctcatgccacaggccaccatgcttatgggcgtgcccacattctacgttcgattgctgcagagtcctcgactcgagaagggtgctgtggccagcatcagactgttcatttctggatcagctcccttgcttgccgaaacccacgccgagtttcatgctcgtactggtcacgccattctcgagcgatacggcatgacggaaaccaacatgaatacttccaacccctacgagggcaagcgtattgccggaaccgttggttttcctctgcccgacgtcactgtgcgagtcaccgatcccgccaccggtctcgttcttccacctgaagagactggcatgatcgagatcaagggacccaacgtcttcaagggctattggcgaatgcccgaaaagaccgctgccgagtttaccgcagacggtttctttatctctggagatctcggcaagatcgaccgagaaggttacgttcacattgtgggacgaggcaaggacctggtcatttccggtggctacaacatctatcccaaagaggtcgaaggcgagatcgaccagatcgagggtgtggtcgagtctgctgtcattggtgttcctcatcccgatttcggagaaggtgtcaccgctgttgtcgtgtgcaaacctggtgccgttctcgacgaaaagaccatcgtgtctgctctgcaggaccgtcttgcccgatacaagcaacccaagcggattatctttgccgacgatctgcctcgaaacactatgggaaaggttcagaagaacattcttcgacagcaatacgccgatctctacaccagacgataagcggccgcatgagaagataaatatataaatacattgagatattaaatgcgctagattagagagcctcatactgctcggagagaagccaagacgagtactcaaaggggattacaccatccatatccacagacacaagctggggaaaggttctatatacactttccggaataccgtagtttccgatgttatcaatgggggcagccaggatttcaggcacttcggtgtctcggggtgaaatggcgttcttggcctccatcaagtcgtaccatgtcttcatttgcctgtcaaagtaaaacagaagcagatgaagaatgaacttgaagtgaaggaatttaaatgtagctaacggtagcaggcgaactactggtacatacctcccccggaatatgtacaggcataatgcgtatctgtgggacatgtggtcgttgcgccattatgtaagcagcgtgtactcctctgactgtccatatggtttgctccatctcaccctcatcgttttcattgttcacaggcggccacaaaaaaactgtcttctctccttctctcttcgccttagtctactcggaccagttttagtttagcttggcgccactggataaatgagacctcaggccttgtgatgaggaggtcacttatgaagcatgttaggaggtgcttgtatggatagagaagcacccaaaataataagaataataataaaacagggggcgttgtcatttcatatcgtgttttcaccatcaatacacctccaaacaatgcccttcatgtggccagccccaatattgtcctgtagttcaactctatgcagctcgtatcttattgagcaagtaaaactctgtcagccgatattgcccgacccgcgacaagggtcaacaaggtggtgtaaggccttcgcagaagtcaaaactgtgccaaacaaacatctagagtctctttggtgtttctcgcatatatttwatcggctgtcttacgtatttgcgcctcggtaccggactaatttcggatcatccccaatacgctttttcttcgcagctgtcaacagtgtccatgatctatccacctaaatgggtcatatgaggcgtataatttcgtggtgctgataataattcccatatatttgacacaaaacttccccccctagacatacatctcacaatctcacttcttgtgcttctgtcacacatctcctccagctgacttcaactcacacctctgccccagttggtctacagcggtataaggtttctccgcatagaggtgcaccactcctcccgatacttgtttgtgtgacttgtgggtcacgacatatatatctacacacattgcgccaccctttggttcttccagcacaacaaaaacacgacacgctaaccatggagtctggacccatgcctgctggcattcccttccctgagtactatgacttctttatggactggaagactcccctggccatcgctgccacctacactgctgccgtcggtctcttcaaccccaaggttggcaaggtctcccgagtggttgccaagtcggctaacgcaaagcctgccgagcgaacccagtccggagctgccatgactgccttcgtctttgtgcacaacctcattctgtgtgtctactctggcatcaccttctactacatgtttcctgctatggtcaagaacttccgaacccacacactgcacgaagcctactgcgacacggatcagtccctctggaacaacgcacttggctactggggttacctcttctacctgtccaagttctacgaggtcattgacaccatcatcatcatcctgaagggacgacggtcctcgctgcttcagacctaccaccatgctggagccatgattaccatgtggtctggcatcaactaccaagccactcccatttggatctttgtggtcttcaactccttcattcacaccatcatgtactgttactatgccttcacctctatcggattccatcctcctggcaaaaagtacctgacttcgatgcagattactcagtttctggtcggtatcaccattgccgtgtcctacctcttcgttcctggctgcatccgaacacccggtgctcagatggctgtctggatcaacgtcggctacctgtttcccttgacctatctgttcgtggactttgccaagcgaacctactccaagcgatctgccattgccgctcagaaaaaggctcagtaagcggccgcaagtgtggatggggaagtgagtgcccggttctgtgtgcacaattggcaatccaagatggatggattcaacacagggatatagcgagctacgtggtggtgcgaggatatagcaacggatatttatgtttgacacttgagaatgtacgatacaagcactgtccaagtacaatactaaacatactgtacatactcatactcgtacccgggcaacggtttcacttgagtgcagtggctagtgctcttactcgtacagtgtgcaatactgcgtatcatagtctttgatgtatatcgtattcattcatgttagttgc

SEQ ID NO: 90 - DNA, 828 bp, Mortierella alpina
  CDS (1)..(828): synthetic C16/18 elongase (codon-optimized for Yarrowia lipolytica)
  ref <302>: TITLE: A MORTIERELLA ALPINA C16/18 FATTY ACID ELONGASE
  ref <310>: PATENT DOCUMENT NUMBER: U.S. 7,470,532
  ref <311>: PATENT FILING DATE: 2005-10-19
  ref <312>: PUBLICATION DATE: 2008-12-30
  ref <313>: RELEVANT RESIDUES IN SEQ ID NO: (1)..(828)
atggagtctggacccatgcctgctggcattcccttccctgagtactatgacttctttatggactggaagactcccctggccatcgctgccacctacactgctgccgtcggtctcttcaaccccaaggttggcaaggtctcccgagtggttgccaagtcggctaacgcaaagcctgccgagcgaacccagtccggagctgccatgactgccttcgtctttgtgcacaacctcattctgtgtgtctactctggcatcaccttctactacatgtttcctgctatggtcaagaacttccgaacccacacactgcacgaagcctactgcgacacggatcagtccctctggaacaacgcacttggctactggggttacctcttctacctgtccaagttctacgaggtcattgacaccatcatcatcatcctgaagggacgacggtcctcgctgcttcagacctaccaccatgctggagccatgattaccatgtggtctggcatcaactaccaagccactcccatttggatctttgtggtcttcaactccttcattcacaccatcatgtactgttactatgccttcacctctatcggattccatcctcctggcaaaaagtacctgacttcgatgcagattactcagtttctggtcggtatcaccattgccgtgtcctacctcttcgttcctggctgcatccgaacacccggtgctcagatggctgtctggatcaacgtcggctacctgtttcccttgacctatctgttcgtggactttgccaagcgaacctactccaagcgatctgccattgccgctcagaaaaaggctcagtaa

SEQ ID NO: 91 - protein, 275 aa, Mortierella alpina
MESGPMPAGIPFPEYYDFFMDWKTPLAIAATYTAAVGLFNPKVGKVSRVVAKSANAKPAERTQSGAAMTAFVFVHNLILCVYSGITFYYMFPAMVKNFRTHTLHEAYCDTDQSLWNNALGYWGYLFYLSKFYEVIDTIIIILKGRRSSLLQTYHHAGAMITMWSGINYQATPIWIFVVFNSFIHTIMYCYYAFTSIGFHPPGKKYLTSMQITQFLVGITIAVSYLFVPGCIRTPGAQMAVWINVGYLFPLTYLFVDFAKRTYSKRSAIAAQKKAQ

SEQ ID NO: 92 - DNA, 13237 bp, Artificial Sequence
  Plasmid pZKMP-ML9DP
gtacgactgatgtgtatgtaagctcaatgagcagcgtgctcctcggtctactatatggcgacatatctcttcgcttctgtttaccctttacatacggtacagctcttacaatgacatttatccactggcgtcgatccataaaccacacgaaccctgttttgttagtcaccatgaccggggcgtgtcgtgttacgttccaccgtttcacctcagccggttacgattcaacttgccgcgtcattctgcgttgctagcggagcgagtacgagtaactagactttcgataagctgaatgacttcagggtgcatgagaggcgcagatcggtattttcggacttgttcttctagaagactggtttgagagcaatcgcggaagagttgggaaccgctggagagcagaatgggttagtacagagactatctgatctcccccgcttgtgtctagccccactttatactctatttggcagttgttgcttgttattcaagcacagcatgtctgctcgtatcactttggagacatccctaacctctaaacctttatagatgccttaccttctgagcttgcagagagcattccacagcgaacccagttgacattatcagttgacatcttacgctcacaccacattacgcatctcacacacaatcacacgcacaagtacacacgcaagcacatcatacaatggtcaaggcgcgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgatgcggtgtgaaataccgcacagatgcgtaaggagaaaataccgcatcaggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggcccgacgtcgcatgctaggagagtctgtcgttcgcgagtggcgcgccaatgtcatgagttacacctgattcaaatagtgaataataatataacagccacaaatgaaagatgtatccacgggtagatatggctttaattactgatgattgaatgattatctgagtgctacagttgtaacgagtacgagttattacctgctactattgtactcctaaatcaaagtactcgtacatgcaatgaattacttgtacttgcgccaatcagatctatcggttgtattgtatataatactagtctattcttttgcttaccagatggtgtaacctccatcgacaatgagatcgtggccggtcatgtagctggaggcgtcggaagccatgaagacaatagggcctccaaactcctcgggctcagccattcgtcggaaaggaattcgtcgctcccagtcgtttcggagctctccgtcagtctcgatgatgtgacgggtcagaggagtaagaatgtagccgggagacagagtgttgactcggatgttgtactgggcccactcggcagccagagacttggccatgtggatgacacctgccttggacatgttgtagggggtctggggctgggggtcgttgacaatggagccactcatggatgcaaccagaatcagagatccaggagactcgtccaggacaagcgacttggccacctcggtagcgaagttgtaggatcccatgaggttgacgtccagcagtcgcttgacctgggggttgggataatcaaaggcagtcatattctcgcagaatccggcacagttaattaagttgcgacacatgtcttgatagtatcttgaattctctctcttgagcttttccataacaagttcttctgcctccaggaagtccatcggtggtttgatcatggttttggtgtagtggtagtgcagtggtggtattgtgactggggatgtagttgagaataagtcatacacaagtcagctttcttcgagcctcatataagtataagtagttcaacgtattagcactgtacccagcatctccgtatcgagaaacacaacaacatgccccattggacagatcatgcggatacacaggttgtgcagtatcatacatactcgatcagacaggtcgtctgaccatcatacaagctgaacaagcgctccatacttgcacgctctctatatacacagttaaattacatatccatagtctaacctctaacagttaatcttctggtaagcctcccagccagccttctggtatcgcttggcctcctcaataggatctcggttctggccgtacagacctcggccgacaattatgatatccgttccggtagacatgacatcctcaacagttcggtactgctgtccgagagcgtctcccttgtcgtcaagacccaccccgggggtcagaataagccagtcctcagagtcgcccttaggtcggttctgggcaatgaagccaaccacaaactcggggtcggatcgggcaagctcaatggtctgcttggagtactcgccagtggccagagagcccttgcaagacagctcggccagcatgagcagacctctggccagcttctcgttgggagaggggactaggaactccttgtactgggagttctcgtagtcagagacgtcctccttcttctgttcagagacagtttcctcggcaccagctcgcaggccagcaatgattccggttccgggtacaccgtgggcgttggtgatatcggaccactcggcgattcggtgacaccggtactggtgcttgacagtgttgccaatatctgcgaactttctgtcctcgaacaggaagaaaccgtgcttaagagcaagttccttgagggggagcacagtgccggcgtaggtgaagtcgtcaatgatgtcgatatgggttttgatcatgcacacataaggtccgaccttatcggcaagctcaatgagctccttggtggtggtaacatccagagaagcacacaggttggttttcttggctgccacgagcttgagcactcgagcggcaaaggcggacttgtggacgttagctcgagcttcgtaggagggcattttggtggtgaagaggagactgaaataaatttagtctgcagaactttttatcggaaccttatctggggcagtgaagtatatgttatggtaatagttacgagttagttgaacttatagatagactggactatacggctatcggtccaaattagaaagaacgtcaatggctctctgggcgtcgcctttgccgacaaaaatgtgatcatgatgaaagccagcaatgacgttgcagctgatattgttgtcggccaaccgcgccgaaaacgcagctgtcagacccacagcctccaacgaagaatgtatcgtcaaagtgatccaagcacactcatagttggagtcgtactccaaaggcggcaatgacgagtcagacagatactcgtcgaccttttccttgggaaccaccaccgtcagcccttctgactcacgtattgtagccaccgacacaggcaacagtccgtggatagcagaatatgtcttgtcggtccatttctcaccaactttaggcgtcaagtgaatgttgcagaagaagtatgtgccttcattgagaatcggtgttgctgatttcaataaagtcttgagatcagtttggccagtcatgttgtggggggtaattggattgagttatcgcctacagtctgtacaggtatactcgctgcccactttatactttttgattccgctgcacttgaagcaatgtcgtttaccaaaagtgagaatgctccacagaacacaccccagggtatggttgagcaaaaaataaacactccgatacggggaatcgaaccccggtctccacggttctcaagaagtattcttgatgagagcgtatcgatggttaatgctgctgtgtgctgtgtgtgtgtgttgtttggcgctcattgttgcgttatgcagcgtacaccacaatattggaagcttattagcctttctattttttcgtttgcaaggcttaacaacattgctgtggagagggatggggatatggaggccgctggagggagtcggagaggcgttttggagcggcttggcctggcgcccagctcgcgaaacgcacctaggaccctttggcacgccgaaatgtgccacttttcagtctagtaacgccttacctacgtcattccatgcgtgcatgtttgcgccttttttcccttgcccttgatcgccacacagtacagtgcactgtacagtggaggttttgggggggtcttagatgggagctaaaagcggcctagcggtacactagtgggattgtatggagtggcatggagcctaggtggagcctgacaggacgcacgaccggctagcccgtgacagacgatgggtggctcctgttgtccaccgcgtacaaatgtttgggccaaagtcttgtcagccttgcttgcgaacctaattcccaattttgtcacttcgcacccccattgatcgagccctaacccctgcccatcaggcaatccaattaagctcgcattgtctgccttgtttagtttggctcctgcccgtttcggcgtccacttgcacaaacacaaacaagcattatatataaggctcgtctctccctcccaaccacactcacttttttgcccgtcttcccttgctaacacaaaagtcaagaacacaaacaaccaccccaacccccttacacacaagacatatctacagcaatggccatggccaaaagcaaacgacggtcggaggctgtggaagagcacgtgaccggctcggacgagggcttgaccgatacttcgggtcacgtgagccctgccgccaagaagcagaagaactcggagattcatttcaccacccaggctgcccagcagttggatcgggagcgcaaggaggagtatctggactcgctgatcgacaacaaggactatctcaagtaccgtcctcgaggctggaagctcaacaacccgcctaccgaccgacctgtgcgaatctacgccgatggagtgtttgatttgttccatctgggacacatgcgtcagctggagcagtccaagaaggccttccccaacgcagtgttgattgtgggcattcccagcgacaaggagacccacaagcggaagggattgaccgtgctgagtgacgtccagcggtacgagacggtgcgacactgcaagtgggtggacgaggtggtggaggatgctccctggtgtgtcaccatggactttctggaaaaacacaaaatcgactacgtggcccatgacgatctgccctacgcttccggcaacgacgatgatatctacaagcccatcaaggagaagggcatgtttctggccacccagcgaaccgagggcatttccacctcggacatcatcaccaagattatccgagactacgacaagtatttaatgcgaaactttgcccggggtgctaaccgaaaggatctcaacgtctcgtggctcaagaagaacgagctggacttcaagcgtcatgtggccgagttccgaaactcgttcaagcgaaagaaggtcggtaaggatctctacggcgagattcgcggtctgctgcagaatgtgctcatttggaacggcgacaactccggcacttccactccccagcgaaagacgctgcagaccaacgccaagaagatgtacatgaacgtgctcaagactctgcaggctcctgacgctgttgacgtggactcctcggagaacgtgtctgagaacgtcactgatgaggaggaggaagacgacgacgaggttgatgaggacgaagaagccgacgacgacgacgaagacgacgaagacgaggaagacgacgagtaggcggccgcattgatgattggaaacacacacatgggttatatctaggtgagagttagttggacagttatatattaaatcagctatgccaacggtaacttcattcatgtcaacgaggaaccagtgactgcaagtaatatagaatttgaccaccttgccattctcttgcactcctttactatatctcatttatttcttatatacaaatcacttcttcttcccagcatcgagctcggaaacctcatgagcaataacatcgtggatctcgtcaatagagggctttttggactccttgctgttggccaccttgtccttgctgtttaaaccacgccaactgatatccccttacgttaccccctcatcacctggtgaggcgaaactgtaaggtgaaagctaaaaatgacatctcagctgcacgaaggaccggggcttaaaagacgggctggtgcttgtgatttaaaactggacaaatctcagcttgcttgaaattttggtctccaactgtttccgagcgaatcgcacacaaaccgggcttctctctgcagaccacgcccccgaaactctttctcccaccaccaccaacactccctttccattcccacaccgttcctctctcgtgcgtcatccttgcgcaatcatcttcgtctgcgacatattgtacgacatacagtaccacggaacgtttcagaccgtcgacgtgaacacatcttaggaacagcaacctgagctacagaaatctatctataggcggataaaaaaacgcacccactgctcgtcctccttgctcctcgaaaccgactcctctacacacgtcaaatccgaggttgaaatcttccccacatttggcagccaaaccagcacatcccagcaacctcgcacagcgccgaaatcgacctgtcgacttggccacaaaaaaaagcaccggctctgcaacagttctcacgaccaattacgtacaagtacgaaatcgttcgtggaccgtgactgataagctcccactttttcttctaacaacaggcaacagacaagtcacacaaaacaaaagccatggtgaaaaacgtggaccaagtggatctctcgcaggtcgacaccattgcctccggccgagatgtcaactacaaggtcaagtacacctccggcgttaagatgagccagggcgcctacgacgacaagggccgccacatttccgagcagcccttcacctgggccaactggcaccagcacatcaactggctcaacttcattctggtgattgcgctgcctctgtcgtcctttgctgccgctcccttcgtctccttcaactggaagaccgccgcgtttgctgtcggctattacatgtgcaccggtctcggtatcaccgccggctaccaccgaatgtgggcccatcgagcctacaaggccgctctgcccgttcgaatcatccttgctctgtttggaggaggagctgtcgagggctccatccgatggtgggcctcgtctcaccgagtccaccaccgatggaccgactccaacaaggacccttacgacgcccgaaagggattctggttctcccactttggctggatgctgcttgtgcccaaccccaagaacaagggccgaactgacatttctgacctcaacaacgactgggttgtccgactccagcacaagtactacgtttacgttctcgtcttcatggccattgttctgcccaccctcgtctgtggctttggctggggcgactggaagggaggtcttgtctacgccggtatcatgcgatacacctttgtgcagcaggtgactttctgtgtcaactcccttgcccactggattggagagcagcccttcgacgaccgacgaactccccgagaccacgctcttaccgccctggtcacctttggagagggctaccacaacttccaccacgagttcccctcggactaccgaaacgccctcatctggtaccagtacgaccccaccaagtggctcatctggaccctcaagcaggttggtctcgcctgggacctccagaccttctcccagaacgccatcgagcagggtctcgtgcagcagcgacagaagaagctggacaagtggcgaaacaacctcaactggggtatccccattgagcagctgcctgtcattgagtttgaggagttccaagagcaggccaagacccgagatctggttctcatttctggcattgtccacgacgtgtctgcctttgtcgagcaccaccctggtggaaaggccctcattatgagcgccgtcggcaaggacggtaccgctgtcttcaacggaggtgtctaccgacactccaacgctggccacaacctgcttgccaccatgcgagtttcggtcattcgaggcggcatggaggttgaggtgtggaagactgcccagaacgaaaagaaggaccagaacattgtctccgatgagagtggaaaccgaatccaccgagctggtctccaggccacccgggtcgagaaccccggtatgtctggcatggctgcttaggcggccgcatgagaagataaatatataaatacattgagatattaaatgcgctagattagagagcctcatactgctcggagagaagccaagacgagtactcaaaggggattacaccatccatatccacagacacaagctggggaaaggttctatatacactttccggaataccgtagtttccgatgttatcaatgggggcagccaggatttcaggcacttcggtgtctcggggtgaaatggcgttcttggcctccatcaagtcgtaccatgtcttcatttgcctgtcaaagtaaaacagaagcagatgaagaatgaacttgaagtgaaggaatttaaattttcgagattttacagatatttctcgcagtttttcacgtccccttgtccttgtcctattgtttcaaataaactctcgtctactgatttcacatggaacctttgctatttcggggataaccccctttgccattgcacgatggacgtggcaaaagaaagatcgccctgcggggatacttatcatgtggtcacatgctgtgattagaaataaagaaaaaggtgcttttttggcgctgtgattaacatctcgtctgccgtgctctactagtcgcaatagcaaaaactcgcttaatagtgtgcatagtgcggggtagcaggatactgaactacagtacgatttgcttgctactgcttgtagcaattacctttactgtagggaccacacctcctggtttcaatgtctttcctcgcctcgacaaagcaaaactgtcacccaatcacaccttgttcatattcattagtgcatccgttaaccttgacatgacacttctcatactagtgatagggctgtagttgagacaagttgattcacacggatacatacaaagcctcagagagcaaatgttatatactcagggaccgaccaatcaaaaaaacacactcctaataaccaccatttccatctacgcgtactcactctgtcagctgccccacattgcccaatgcacaatgcacaatgatgtgtgcaaacaacgcaatcaaaagtctatggatgctgaccaaactctgatcaccaagttgcgaacatgaaaaagaagacctgtgtatatataagtaagggggagagccctaactagatctttcgaaaaccccccgaccttcaccttccacaaccatgatcatcttatacgttttggccgttgcggtctccttcctcatcttcaagagagtcacctacaccatggcttctattggttcgtccaaccccgtgctcttggctgcgattcccttcgtctacctgtttgtcctcccacgagtcctggctttcctgcctcagaaggctcagttcctggccaaatgtattgtggtcctgattgccacgcttatcatgtccgttgcaggctgcttcatctcgatcgtgtgcgctcttctggacaagagatacgtcatcaattacgttgtgtcgcgattgttctccttccttgccgctcgaccgtgtggtgtgacctataagattgttggtgaggaacacctcgataagtaccctgctatcgtggtctgtaaccatcaatcctctatggatatgatggttttgggacgagtttttccaaagcactgcgttgtcatggcgaagaaggaactcctgtactttccctttttgggaatgtttatgaaactgagcaacgctatcttcatcgaccggaagaaccacaagaaagccatcgagtctaccacccaagccgtggcggacatgaagaagcacaactctggaatctggattttcccagagggcacccggtctagactggacaaggcagacctgctgcccttcaagaaaggtgcctttcatcttgcaattcaggcccagctccctattctccccattatctcgcagggctattcccatatctacgactcttcgaagcggtacttccccggtggagagctcgagatcagagtcctggagcccattcctacaactggcctcactactgatgatgtgaacgacctgatggacaagacacgaaaccttatgctcaagcacttgaaggagatggattcccagtattcgtcgagcactgctgaaaatggatccacgcacatcgacgccgatattgccaagtctacagccaccagcattggcaacactgacgacgcaattacaaaacgtcgtacccctaaggaataagcggccgcaagtgtggatggggaagtgagtgcccggttctgtgtgcacaattggcaatccaagatggatggattcaacacagggatatagcgagctacgtggtggtgcgaggatatagcaacggatatttatgtttgacacttgagaatgtacgatacaagcactgtccaagtacaatactaaacatactgtacatactcatactcgtacccgggcaacggtttcacttgagtgcagtggctagtgctcttactcgtacagtgtgcaatactgcgtatcatagtctttgatgtatatcgtattcattcatgttagttgc

SEQ ID NO: 93 - DNA, 899 bp, Yarrowia lipolytica
tttcgagattttacagatatttctcgcagtttttcacgtccccttgtccttgtcctattgtttcaaataaactctcgtctactgatttcacatggaacctttgctatttcggggataaccccctttgccattgcacgatggacgtggcaaaagaaagatcgccctgcggggatacttatcatgtggtcacatgctgtgattagaaataaagaaaaaggtgcttttttggcgctgtgattaacatctcgtctgccgtgctctactagtcgcaatagcaaaaactcgcttaatagtgtgcatagtgcggggtagcaggatactgaactacagtacgatttgcttgctactgcttgtagcaattacctttactgtagggaccacacctcctggtttcaatgtctttcctcgcctcgacaaagcaaaactgtcacccaatcacaccttgttcatattcattagtgcatccgttaaccttgacatgacacttctcatactagtgatagggctgtagttgagacaagttgattcacacggatacatacaaagcctcagagagcaaatgttatatactcagggaccgaccaatcaaaaaaacacactcctaataaccaccatttccatctacgcgtactcactctgtcagctgccccacattgcccaatgcacaatgcacaatgatgtgtgcaaacaacgcaatcaaaagtctatggatgctgaccaaactctgatcaccaagttgcgaacatgaaaaagaagacctgtgtatatataagtaagggggagagccctaactagatctttcgaaaaccccccgaccttcaccttccacaaccatgatcatcttatacgttttggccgttgcggtctccttcctcatcttcaagagagtcacctacacc

SEQ ID NO: 94 - DNA, 722 bp, Yarrowia lipolytica
ccacgccaactgatatccccttacgttaccccctcatcacctggtgaggcgaaactgtaaggtgaaagctaaaaatgacatctcagctgcacgaaggaccggggcttaaaagacgggctggtgcttgtgatttaaaactggacaaatctcagcttgcttgaaattttggtctccaactgtttccgagcgaatcgcacacaaaccgggcttctctctgcagaccacgcccccgaaactctttctcccaccaccaccaacactccctttccattcccacaccgttcctctctcgtgcgtcatccttgcgcaatcatcttcgtctgcgacatattgtacgacatacagtaccacggaacgtttcagaccgtcgacgtgaacacatcttaggaacagcaacctgagctacagaaatctatctataggcggataaaaaaacgcacccactgctcgtcctccttgctcctcgaaaccgactcctctacacacgtcaaatccgaggttgaaatcttccccacatttggcagccaaaccagcacatcccagcaacctcgcacagcgccgaaatcgacctgtcgacttggccacaaaaaaaagcaccggctctgcaacagttctcacgaccaattacgtacaagtacgaaatcgttcgtggaccgtgactgataagctcccactttttcttctaacaacaggcaacagacaagtcacacaaaacaaaagcc

SEQ ID NO: 95 - DNA, 13320 bp, Artificial Sequence
  Plasmid pZKMP-ML9DCB
cgatggttaatgctgctgtgtgctgtgtgtgtgtgttgtttggcgctcattgttgcgttatgcagcgtacaccacaatattggaagcttattagcctttctattttttcgtttgcaaggcttaacaacattgctgtggagagggatggggatatggaggccgctggagggagtcggagaggcgttttggagcggcttggcctggcgcccagctcgcgaaacgcacctaggaccctttggcacgccgaaatgtgccacttttcagtctagtaacgccttacctacgtcattccatgcgtgcatgtttgcgccttttttcccttgcccttgatcgccacacagtacagtgcactgtacagtggaggttttgggggggtcttagatgggagctaaaagcggcctagcggtacactagtgggattgtatggagtggcatggagcctaggtggagcctgacaggacgcacgaccggctagcccgtgacagacgatgggtggctcctgttgtccaccgcgtacaaatgtttgggccaaagtcttgtcagccttgcttgcgaacctaattcccaattttgtcacttcgcacccccattgatcgagccctaacccctgcccatcaggcaatccaattaagctcgcattgtctgccttgtttagtttggctcctgcccgtttcggcgtccacttgcacaaacacaaacaagcattatatataaggctcgtctctccctcccaaccacactcacttttttgcccgtcttcccttgctaacacaaaagtcaagaacacaaacaaccaccccaacccccttacacacaagacatatctacagcaatggccatgggcgtattcattaaacaggagcagcttccggctctcaagaagtacaagtactccgccgaggatcactcgttcatctccaacaacattctgcgccccttctggcgacagtttgtcaaaatcttccctctgtggatggcccccaacatggtgactctgctgggcttcttctttgtcattgtgaacttcatcaccatgctcattgttgatcccacccacgaccgcgagcctcccagatgggtctacctcacctacgctctgggtctgttcctttaccagacatttgatgcctgtgacggatcccatgcccgacgaactggccagagtggaccccttggagagctgtttgaccactgtgtcgacgccatgaatacctctctgattctcacggtggtggtgtccaccacccatatgggatataacatgaagctactgattgtgcagattgccgctctcggaaacttctacctgtcgacctgggagacctaccataccggaactctgtacctttctggcttctctggtcctgttgaaggtatcttgattctggtggctcttttcgtcctcaccttcttcactggtcccaacgtgtacgctctgaccgtctacgaggctcttcccgagtccatcacttcgctgctgcctgccagcttcctggacgtcaccatcacccagatctacattggattcggagtgctgggcatggtgttcaacatctacggcgcctgcggaaacgtgatcaagtactacaacaacaagggcaagagcgctctccccgccattctcggaatcgccccctttggcatcttctacgtcggcgtctttgcctgggcccatgttgctcctctgcttctctccaagtacgccatcgtctatctgtttgccattggggctgcctttgccatgcaagtcggccagatgattcttgcccatctcgtgcttgctccctttccccactggaacgtgctgctcttcttcccctttgtgggactggcagtgcactacattgcacccgtgtttggctgggacgccgatatcgtgtcggttaacactctcttcacctgttttggcgccaccctctccatttacgccttctttgtgcttgagatcatcgacgagatcaccaactacctcgatatctggtgtctgcgaatcaagtaccctcaggagaagaagaccgaataagcggccgcatgtacatacaagattatttatagaaatgaatcgcgatcgaacaaagagtacgagtgtacgagtaggggatgatgataaaagtggaagaagttccgcatctttggatttatcaacgtgtaggacgatacttcctgtaaaaatgcaatgtctttaccataggttctgctgtagatgttattaactaccattaacatgtctacttgtacagttgcagaccagttggagtatagaatggtacacttaccaaaaagtgttgatggttgtaactacgatatataaaactgttgacgggatctgcgtacactgtttaaaccacgccaactgatatccccttacgttaccccctcatcacctggtgaggcgaaactgtaaggtgaaagctaaaaatgacatctcagctgcacgaaggaccggggcttaaaagacgggctggtgcttgtgatttaaaactggacaaatctcagcttgcttgaaattttggtctccaactgtttccgagcgaatcgcacacaaaccgggcttctctctgcagaccacgcccccgaaactctttctcccaccaccaccaacactccctttccattcccacaccgttcctctctcgtgcgtcatccttgcgcaatcatcttcgtctgcgacatattgtacgacatacagtaccacggaacgtttcagaccgtcgacgtgaacacatcttaggaacagcaacctgagctacagaaatctatctataggcggataaaaaaacgcacccactgctcgtcctccttgctcctcgaaaccgactcctctacacacgtcaaatccgaggttgaaatcttccccacatttggcagccaaaccagcacatcccagcaacctcgcacagcgccgaaatcgacctgtcgacttggccacaaaaaaaagcaccggctctgcaacagttctcacgaccaattacgtacaagtacgaaatcgttcgtggaccgtgactgataagctcccactttttcttctaacaacaggcaacagacaagtcacacaaaacaaaagccatggtgaaaaacgtggaccaagtggatctctcgcaggtcgacaccattgcctccggccgagatgtcaactacaaggtcaagtacacctccggcgttaagatgagccagggcgcctacgacgacaagggccgccacatttccgagcagcccttcacctgggccaactggcaccagcacatcaactggctcaacttcattctggtgattgcgctgcctctgtcgtcctttgctgccgctcccttcgtctccttcaactggaagaccgccgcgtttgctgtcggctattacatgtgcaccggtctcggtatcaccgccggctaccaccgaatgtgggcccatcgagcctacaaggccgctctgcccgttcgaatcatccttgctctgtttggaggaggagctgtcgagggctccatccgatggtgggcctcgtctcaccgagtccaccaccgatggaccgactccaacaaggacccttacgacgcccgaaagggattctggttctcccactttggctggatgctgcttgtgcccaaccccaagaacaagggccgaactgacatttctgacctcaacaacgactgggttgtccgactccagcacaagtactacgtttacgttctcgtcttcatggccattgttctgcccaccctcgtctgtggctttggctggggcgactggaagggaggtcttgtctacgccggtatcatgcgatacacctttgtgcagcaggtgactttctgtgtcaactcccttgcccactggattggagagcagcccttcgacgaccgacgaactccccgagaccacgctcttaccgccctggtcacctttggagagggctaccacaacttccaccacgagttcccctcggactaccgaaacgccctcatctggtaccagtacgaccccaccaagtggctcatctggaccctcaagcaggttggtctcgcctgggacctccagaccttctcccagaacgccatcgagcagggtctcgtgcagcagcgacagaagaagctggacaagtggcgaaacaacctcaactggggtatccccattgagcagctgcctgtcattgagtttgaggagttccaagagcaggccaagacccgagatctggttctcatttctggcattgtccacgacgtgtctgcctttgtcgagcaccaccctggtggaaaggccctcattatgagcgccgtcggcaaggacggtaccgctgtcttcaacggaggtgtctaccgacactccaacgctggccacaacctgcttgccaccatgcgagtttcggtcattcgaggcggcatggaggttgaggtgtggaagactgcccagaacgaaaagaaggaccagaacattgtctccgatgagagtggaaaccgaatccaccgagctggtctccaggccacccgggtcgagaaccccggtatgtctggcatggctgcttaggcggccgcatgagaagataaatatataaatacattgagatattaaatgcgctagattagagagcctcatactgctcggagagaagccaagacgagtactcaaaggggattacaccatccatatccacagacacaagctggggaaaggttctatatacactttccggaataccgtagtttccgatgttatcaatgggggcagccaggatttcaggcacttcggtgtctcggggtgaaatggcgttcttggcctccatcaagtcgtaccatgtcttcatttgcctgtcaaagtaaaacagaagcagatgaagaatgaacttgaagtgaaggaatttaaattttcgagattttacagatatttctcgcagtttttcacgtccccttgtccttgtcctattgtttcaaataaactctcgtctactgatttcacatggaacctttgctatttcggggataaccccctttgccattgcacgatggacgtggcaaaagaaagatcgccctgcggggatacttatcatgtggtcacatgctgtgattagaaataaagaaaaaggtgcttttttggcgctgtgattaacatctcgtctgccgtgctctactagtcgcaatagcaaaaactcgcttaatagtgtgcatagtgcggggtagcaggatactgaactacagtacgatttgcttgctactgcttgtagcaattacctttactgtagggaccacacctcctggtttcaatgtctttcctcgcctcgacaaagcaaaactgtcacccaatcacaccttgttcatattcattagtgcatccgttaaccttgacatgacacttctcatactagtgatagggctgtagttgagacaagttgattcacacggatacatacaaagcctcagagagcaaatgttatatactcagggaccgaccaatcaaaaaaacacactcctaataaccaccatttccatctacgcgtactcactctgtcagctgccccacattgcccaatgcacaatgcacaatgatgtgtgcaaacaacgcaatcaaaagtctatggatgctgaccaaactctgatcaccaagttgcgaacatgaaaaagaagacctgtgtatatataagtaagggggagagccctaactagatctttcgaaaaccccccgaccttcaccttccacaaccatgatcatcttatacgttttggccgttgcggtctccttcctcatcttcaagagagtcacctacaccatggcttctattggttcgtccaaccccgtgctcttggctgcgattcccttcgtctacctgtttgtcctcccacgagtcctggctttcctgcctcagaaggctcagttcctggccaaatgtattgtggtcctgattgccacgcttatcatgtccgttgcaggctgcttcatctcgatcgtgtgcgctcttctggacaagagatacgtcatcaattacgttgtgtcgcgattgttctccttccttgccgctcgaccgtgtggtgtgacctataagattgttggtgaggaacacctcgataagtaccctgctatcgtggtctgtaaccatcaatcctctatggatatgatggttttgggacgagtttttccaaagcactgcgttgtcatggcgaagaaggaactcctgtactttccctttttgggaatgtttatgaaactgagcaacgctatcttcatcgaccggaagaaccacaagaaagccatcgagtctaccacccaagccgtggcggacatgaagaagcacaactctggaatctggattttcccagagggcacccggtctagactggacaaggcagacctgctgcccttcaagaaaggtgcctttcatcttgcaattcaggcccagctccctattctccccattatctcgcagggctattcccatatctacgactcttcgaagcggtacttccccggtggagagctcgagatcagagtcctggagcccattcctacaactggcctcactactgatgatgtgaacgacctgatggacaagacacgaaaccttatgctcaagcacttgaaggagatggattcccagtattcgtcgagcactgctgaaaatggatccacgcacatcgacgccgatattgccaagtctacagccaccagcattggcaacactgacgacgcaattacaaaacgtcgtacccctaaggaataagcggccgcaagtgtggatggggaagtgagtgcccggttctgtgtgcacaattggcaatccaagatggatggattcaacacagggatatagcgagctacgtggtggtgcgaggatatagcaacggatatttatgtttgacacttgagaatgtacgatacaagcactgtccaagtacaatactaaacatactgtacatactcatactcgtacccgggcaacggtttcacttgagtgcagtggctagtgctcttactcgtacagtgtgcaatactgcgtatcatagtctttgatgtatatcgtattcattcatgttagttgcgtacgactgatgtgtatgtaagctcaatgagcagcgtgctcctcggtctactatatggcgacatatctcttcgcttctgtttaccctttacatacggtacagctcttacaatgacatttatccactggcgtcgatccataaaccacacgaaccctgttttgttagtcaccatgaccggggcgtgtcgtgttacgttccaccgtttcacctcagccggttacgattcaacttgccgcgtcattctgcgttgctagcggagcgagtacgagtaactagactttcgataagctgaatgacttcagggtgcatgagaggcgcagatcggtattttcggacttgttcttctagaagactggtttgagagcaatcgcggaagagttgggaaccgctggagagcagaatgggttagtacagagactatctgatctcccccgcttgtgtctagccccactttatactctatttggcagttgttgcttgttattcaagcacagcatgtctgctcgtatcactttggagacatccctaacctctaaacctttatagatgccttaccttctgagcttgcagagagcattccacagcgaacccagttgacattatcagttgacatcttacgctcacaccacattacgcatctcacacacaatcacacgcacaagtacacacgcaagcacatcatacaatggtcaaggcgcgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgatgcggtgtgaaataccgcacagatgcgtaaggagaaaataccgcatcaggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggcccgacgtcgcatgctaggagagtctgtcgttcgcgagtggcgcgccaatgtcatgagttacacctgattcaaatagtgaataataatataacagccacaaatgaaagatgtatccacgggtagatatggctttaattactgatgattgaatgattatctgagtgctacagttgtaacgagtacgagttattacctgctactattgtactcctaaatcaaagtactcgtacatgcaatgaattacttgtacttgcgccaatcagatctatcggttgtattgtatataatactagtctattcttttgcttaccagatggtgtaacctccatcgacaatgagatcgtggccggtcatgtagctggaggcgtcggaagccatgaagacaatagggcctccaaactcctcgggctcagccattcgtcggaaaggaattcgtcgctcccagtcgtttcggagctctccgtcagtctcgatgatgtgacgggtcagaggagtaagaatgtagccgggagacagagtgttgactcggatgttgtactgggcccactcggcagccagagacttggccatgtggatgacacctgccttggacatgttgtagggggtctggggctgggggtcgttgacaatggagccactcatggatgcaaccagaatcagagatccaggagactcgtccaggacaagcgacttggccacctcggtagcgaagttgtaggatcccatgaggttgacgtccagcagtcgcttgacctgggggttgggataatcaaaggcagtcatattctcgcagaatccggcacagttaattaagttgcgacacatgtcttgatagtatcttgaattctctctcttgagcttttccataacaagttcttctgcctccaggaagtccatcggtggtttgatcatggttttggtgtagtggtagtgcagtggtggtattgtgactggggatgtagttgagaataagtcatacacaagtcagctttcttcgagcctcatataagtataagtagttcaacgtattagcactgtacccagcatctccgtatcgagaaacacaacaacatgccccattggacagatcatgcggatacacaggttgtgcagtatcatacatactcgatcagacaggtcgtctgaccatcatacaagctgaacaagcgctccatacttgcacgctctctatatacacagttaaattacatatccatagtctaacctctaacagttaatcttctggtaagcctcccagccagccttctggtatcgcttggcctcctcaataggatctcggttctggccgtacagacctcggccgacaattatgatatccgttccggtagacatgacatcctcaacagttcggtactgctgtccgagagcgtctcccttgtcgtcaagacccaccccgggggtcagaataagccagtcctcagagtcgcccttaggtcggttctgggcaatgaagccaaccacaaactcggggtcggatcgggcaagctcaatggtctgcttggagtactcgccagtggccagagagcccttgcaagacagctcggccagcatgagcagacctctggccagcttctcgttgggagaggggactaggaactccttgtactgggagttctcgtagtcagagacgtcctccttcttctgttcagagacagtttcctcggcaccagctcgcaggccagcaatgattccggttccgggtacaccgtgggcgttggtgatatcggaccactcggcgattcggtgacaccggtactggtgcttgacagtgttgccaatatctgcgaactttctgtcctcgaacaggaagaaaccgtgcttaagagcaagttccttgagggggagcacagtgccggcgtaggtgaagtcgtcaatgatgtcgatatgggttttgatcatgcacacataaggtccgaccttatcggcaagctcaatgagctccttggtggtggtaacatccagagaagcacacaggttggttttcttggctgccacgagcttgagcactcgagcggcaaaggcggacttgtggacgttagctcgagcttcgtaggagggcattttggtggtgaagaggagactgaaataaatttagtctgcagaactttttatcggaaccttatctggggcagtgaagtatatgttatggtaatagttacgagttagttgaacttatagatagactggactatacggctatcggtccaaattagaaagaacgtcaatggctctctgggcgtcgcctttgccgacaaaaatgtgatcatgatgaaagccagcaatgacgttgcagctgatattgttgtcggccaaccgcgccgaaaacgcagctgtcagacccacagcctccaacgaagaatgtatcgtcaaagtgatccaagcacactcatagttggagtcgtactccaaaggcggcaatgacgagtcagacagatactcgtcgaccttttccttgggaaccaccaccgtcagcccttctgactcacgtattgtagccaccgacacaggcaacagtccgtggatagcagaatatgtcttgtcggtccatttctcaccaactttaggcgtcaagtgaatgttgcagaagaagtatgtgccttcattgagaatcggtgttgctgatttcaataaagtcttgagatcagtttggccagtcatgttgtggggggtaattggattgagttatcgcctacagtctgtacaggtatactcgctgcccactttatactttttgattccgctgcacttgaagcaatgtcgtttaccaaaagtgagaatgctccacagaacacaccccagggtatggttgagcaaaaaataaacactccgatacggggaatcgaaccccggtctccacggttctcaagaagtattcttgatgagagcgtat

SEQ ID NO: 96 - DNA, 13975 bp, Artificial Sequence
  Plasmid pZKSL-5S5A5
cgatggttaatgctgctgtgtgctgtgtgtgtgtgttgtttggcgctcattgttgcgttatgcagcgtacaccacaatattggaagcttattagcctttctattttttcgtttgcaaggcttaacaacattgctgtggagagggatggggatatggaggccgctggagggagtcggagaggcgttttggagcggcttggcctggcgcccagctcgcgaaacgcacctaggaccctttggcacgccgaaatgtgccacttttcagtctagtaacgccttacctacgtcattccatgcgtgcatgtttgcgccttttttcccttgcccttgatcgccacacagtacagtgcactgtacagtggaggttttgggggggtcttagatgggagctaaaagcggcctagcggtacactagtgggattgtatggagtggcatggagcctaggtggagcctgacaggacgcacgaccggctagcccgtgacagacgatgggtggctcctgttgtccaccgcgtacaaatgtttgggccaaagtcttgtcagccttgcttgcgaacctaattcccaattttgtcacttcgcacccccattgatcgagccctaacccctgcccatcaggcaatccaattaagctcgcattgtctgccttgtttagtttggctcctgcccgtttcggcgtccacttgcacaaacacaaacaagcattatatataaggctcgtctctccctcccaaccacactcacttttttgcccgtcttcccttgctaacacaaaagtcaagaacacaaacaaccaccccaacccccttacacacaagacatatctacagcaatggccatggctctcagtcttaccacagaacagctgttagaacgccctgatttggttgcgattgatggcatcctctacgaccttgaagggcttgccaaagttcatccaggatccgatttgattctcgcttctggtgcctctgatgcctcccctctcttttattcaatgcatccatacgtcaaaccggagaactccaaattgcttcaacagttcgtccgagggaagcatgaccgcacctcgaaggacattgtctacacgtatgattctcccttcgcacaagacgttaagcggacaatgcgcgaggtgatgaaagggaggaactggtacgcaacccctggcttctggctgcgcaccgttgggatcatcgccgtgacggccttttgcgagtggcactgggctaccacggggatggtgctgtggggcctgttgactggattcatgcacatgcagatcggcttatccatccagcatgatgcgtcccacggggccatcagcaagaagccttgggtcaacgccctcttcgcctacggcattgacgtcatcggatcgtcccggtggatttggctgcagtcgcacatcatgcggcaccacacctacaccaaccagcacggcctcgacctggatgcggagtcggcagagccgttcctggtgttccacaactaccccgccgcaaacaccgcccgaaagtggttccaccgcttccaggcttggtacatgtaccttgtgctgggggcatacggggtatcgctggtgtacaacccgctctacattttccggatgcagcacaatgacaccatcccagagtctgtcacggccatgcgggaaaatggctttctgcggcgctaccgcacacttgcattcgtgatgcgagctttcttcatcttccggaccgcattcttgccctggtacctcactgggacctcattgctgatcaccattcctctggtgcccaccgcaactggtgccttcttgacgttcttcttcattttgtcccacaattttgatggctccgaacggatccccgacaagaactgcaaggttaagcgatctgagaaggacgttgaggctgaccaaattgactggtatcgggcgcaggtggagacgtcctccacatacggtggccccatcgccatgttcttcactggcggtctcaatttccagatcgagcaccacctctttccccggatgtcgtcttggcactaccccttcgtccagcaggcggtccgggagtgttgcgaacgacatggagtgcgatatgttttctaccctaccatcgtcggcaacatcatctccaccctgaagtacatgcataaggtgggtgtcgtccactgcgtgaaggacgcacaggattcctaagcggccgcattgatgattggaaacacacacatgggttatatctaggtgagagttagttggacagttatatattaaatcagctatgccaacggtaacttcattcatgtcaacgaggaaccagtgactgcaagtaatatagaatttgaccaccttgccattctcttgcactcctttactatatctcatttatttcttatatacaaatcacttcttcttcccagcatcgagctcggaaacctcatgagcaataacatcgtggatctcgtcaatagagggctttttggactccttgctgttggccaccttgtccttgctgtctggctcattctgtttcaacgccttttaattaactctcctgcagcttcctcagcgagacactgctcctgtctggacccgagctaaggctctgttcgacaaacacgttctgcgaattggcgagtaatttcattaatgcaaatagacgtgtatttgaaaaggaggagatgatggtaccagtaatttacggtgtttgaatagacaaattatatatataaaattaacctgatgaatgagtgtatgaatggattgcttaatataccgagggagagccggcattatcaatatttattgtcctaagaagctaaaatatgctgttccgttgatagcgatgtctgtttgagagtcaatggcagaacgcggaggagtattgttagttggtgatcggtttactcgacatcgagtagggggcgagacagaagatatcccgaatccattgcattgtttattaggatgttcacaacacaactccctctagactctggggatgtgcgttagaagaatgacctggagcaagagtgttcagattgatccgttcaaattttcaagattactgttggggttgtttttgaatccacattagctggacgactattgcatctgagcgctcggaacgtctccctttcccttcagctttatacgagtcgattccataagcgcgacctctcgaattgccttcggttgtgaagccataggcaaaggtgtggctatggaatgcatgcgacgtcgggcccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttcctgatgcggtattttctccttacgcatctgtgcggtatttcacaccgcatcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcgcgccgaggtttccaacgagataacatcgtggcagctgccaccatgaccgatatgcctgaaataagtgaattgaccatcagaagttctgcattcaaatagaactatatcatattcggctcagttttttcaataatagtccaatccctaagtctcctatccaaaatggttcctgaccagccacatccatgatcatgactgcgtgacaggaacagtcattccgtggatgaacgactttacgctcaggtactgtaaatatctgtaaagggcagacaaccaaccaattgagtaacctgtgagacttgaaacgtaagatgacttcacacacaaagtcacttgactcaaccgtggctctcaattgcacaaaatcactctgcactaatctattgcaggagtcaggctatgaacaactagacgacagctacttatgtgttatatagaggaatattaaaaaatctaagaataatcataaagttacaaaataattatcagatttcgagccacaggtcacccctaacatgtgttattgcacacccacaatcctcagcttgatgtcatttaattcttccagccaccatctctctctccaaccctaatggcaaactttattttggtggagcgatgactcttactcaactgcagcatacttaagcacaattgttccccagcctgatacgacacaccatccattgtcaagcttcaccacatacaacaacacagcgtacgcaactaacatgaatgaatacgatatacatcaaagactatgatacgcagtattgcacactgtacgagtaagagcactagccactgcactcaagtgaaaccgttgcccgggtacgagtatgagtatgtacagtatgtttagtattgtacttggacagtgcttgtatcgtacattctcaagtgtcaaacataaatatccgttgctatatcctcgcaccaccacgtagctcgctatatccctgtgttgaatccatccatcttggattgccaattgtgcacacagaaccgggcactcacttccccatccacacttgcggccgcttaggaatcctgagcgtccttgacacagtgaaccacaccgactttgtgcatgtacttgagggtggaaatgatgttgcccacaatggtagggtagaagacgtaccgaactccgtgtcgttcgcaacactctcggacagcttgctgcacgaagggatagtgccaagacgacattcgaggaaagaggtgatgctcgatctggaagttgagaccgccagtaaagaacatggcaatgggtccaccgtaggtggaagaggtctccacctgagctctgtaccagtcgatctgatcggcttcaacgtccttctcggagctcttgaccttgcagttcttgtcggggattcgctccgagccatcgaagttgtgagacaagatgaaaaagaaggtgaggaaggcaccggtagcagtgggcaccagaggaatggtgatgagcagggaggttccagtgagataccagggcaagaaggcggttcgaaagatgaagaaagctcgcataacgaatgcaagggttcggtaccgtcgcagaaagccgttctctcgcatggctgtgacagactcgggaatggtgtcgttgtgctgcattcggaagatgtagagagggttgtacaccagcgaaacgccgtaggctccaagcacgaggtacatgtaccaggcctggaatcggtgaaaccactttcgagcagtgttggcagcagggtagttgtggaacacaaggaatggttctgcggactcggcatccaggtcgagaccatgctgattggtgtaggtgtgatgtcgcatgatgtgagactgcagccagatccatctggacgatccaatgacgtcgatgccgtaggcaaagagagcgttgacccagggctttttgctgatggcaccatgagaggcatcgtgctgaatggacaggccgatctgcatgtgcatgaatccagtcaagagaccccacagcaccattccggtagtagcccagtgccactcgcaaaaggcggtgacagcaatgatgccaacggttcgcagccagaatccaggtgtggcataccagttccgacctttcatgacctctcgcatagttcgcttgacgtcctgtgcaaagggagagtcgtaggtgtagacaatgtccttggaggttcggtcgtgcttgcctcgcacgaactgttgaagcagcttcgagttctcgggcttgacgtaagggtgcatggagtagaacagaggagaagcatcggaggcaccagaagcgaggatcaagtcggatccgggatggaccttggcaagaccttccagatcgtagagaatgccgtcgatggcaaccaggtcgggtcgctcgagcagctgctcggtagtaagggagagagccatggagagctgggttagtttgtgtagagagtgtgtgttgctagcgactttcggattgtgtcattacacaaaacgcgtcgtctcgacactgatcttgtcgtggatactcacggctcggacatcgtcgccgacgatgacaccggactttcgcttaaggacgtcagtaacaggcattgtgtgatgtgtagtttagatttcgaatctgtggggaaagaaaggaaaaaagagactggcaaccgattgggagagccactgtttatatataccctagacaagccccccgcttgtaagatgttggtcaatgtaaaccagtattaaggttggcaagtgcaggagaagcaaggtgtgggtaccgagcaatggaaatgtgcggaaggcaaaaaaatgaggccacggcctattgtcggggctatatccagggggcgattgaagtacactaacatgacatgtgtccacagaccctcaatctggcctgatgagccaaatccatacgcgctttcgcagctctaaaggctataacaagtcacaccaccctgctcgacctcagcgccctcactttttgttaagacaaactgtacacgctgttccagcgttttctgcctgcacctggtgggacatttggtgcaacctaaagtgctcggaacctctgtggtgtccagatcagcgcagcagttccgaggtagttttgaggcccttagatgatgcaatggtgtcagtcgctggatcacgagtcttaatggcagtattcgttcttatttgtgccattgagccccgttatcctcgtatcttctaccccccatcccatccctttgttggtgcaaccctacccatttattgttgggtgcagcccaaccgacgtggagagcttggcttggccatataaaaaggcccccccctagtggcaatggcagaaagtcagctgtgagttgttgaatttgtcatctaggcggcctggccgtcttctccggggcaattggggctgttttttgggacacaaatacgccgccaacccggtctctcctgaattctgcagatgggctgcaggaattccgtcgtcgcctgagtcgactccaacttttcacactgagcgtaaaatgtggagaagaaatcggcactaaaaagtcaggtagactggaaaatgcgccatgaaatgaatatctcttgctacagtaatgcccagcatcgaggggtattgtgtcaccaacactatagtggcagctgaagcgctcgtgattgtagtatgagtctttattggtgatgggaagagttcactcaatattctcgttactgccaaaacaccacggtaatcggccagacaccatggatgtagatcaccaagcctgtgaatgttattcgagctaaaatgcacatggttggtgaaaggagtagttgctgtcgaattccgtcgtcgcctgagtcatcatttatttaccagttggccacaaacccttgacgatctcgtatgtcccctccgacatactcccggccggctggggtacgttcgatagcgctatcggcatcgacaaggtttgggtccctagccgataccgcactacctgagtcacaatcttcggaggtttagtcttccacatagcacgggcaaaagtgcgtatatatacaagagcgtttgccagccacagattttcactccacacaccacatcacacatacaaccacacacatccacaatggaacccgaaactaagaagaccaagactgactccaagaagattgttcttctcggcggcgacttctgtggccccgaggtgattgccgaggccgtcaaggtgctcaagtctgttgctgaggcctccggcaccgagtttgtgtttgaggaccgactcattggaggagctgccattgagaaggagggcgagcccatcaccgacgctactctcgacatctgccgaaaggctgactctattatgctcggtgctgtcggaggcgctgccaacaccgtatggaccactcccgacggacgaaccgacgtgcgacccgagcagggtctcctcaagctgcgaaaggacctgaacctgtacgccaacctgcgaccctgccagctgctgtcgcccaagctcgccgatctctcccccatccgaaacgttgagggcaccgacttcatcattgtccgagagctcgtcggaggtatctactttggagagcgaaaggaggatgacggatctggcgtcgcttccgacaccgagacctactccgttcctgaggttgagcgaattgcccgaatggccgccttcctggcccttcagcacaacccccctcttcccgtgtggtctcttgacaaggccaacgtgctggcctcctctcgactttggcgaaagactgtcactcgagtcctcaaggacgaattcccccagctcgagctcaaccaccagctgatcgactcggccgccatgatcctcatcaagcagccctccaagatgaatggtatcatcatcaccaccaacatgtttggcgatatcatctccgacgaggcctccgtcatccccggttctctgggtctgctgccctccgcctctctggcttctctgcccgacaccaacgaggcgttcggtctgtacgagccctgtcacggatctgcccccgatctcggcaagcagaaggtcaaccccattgccaccattctgtctgccgccatgatgctcaagttctctcttaacatgaagcccgccggtgacgctgttgaggctgccgtcaaggagtccgtcgaggctggtatcactaccgccgatatcggaggctcttcctccacctccgaggtcggagacttgttgccaacaaggtcaaggagctgctcaagaaggagtaagtcgtttctacgacgcattgatggaaggagcaaactgacgcgcctgcgggttggtctaccggcagggtccgctagtgtataagactctataaaaagggccctgccctgctaatgaaatgatgatttataatttaccggtgtagcaaccttgactagaagaagcagattgggtgtgtttgtagtggaggacagtggtacgttttggaaacagtcttcttgaaagtgtcttgtctacagtatattcactcataacctcaatagccaagggtgtagtcggtttattaaaggaagggagttgtggctgatgtggatagatatctttaagctggcgactgcacccaacgagtgtggtggtagcttgtttaaacagagtgtgaaagactcactatggtccgggcttatctcgaccaatagccaaagtctggagtttctgagagaaaaaggcaagatacgtatgtaacaaagcgacgcatggtacaataataccggaggcatgtatcatagagagttagtggttcgatgatggcactggtgcctggtatgactttatacggctgactacatatttgtcctcagacatacaattacagtcaagcacttacccttggacatctgtaggtaccccccggccaagacgatctcagcgtgtcgtatgtcggattggcgtagctccctcgctcgtcaattggctcccatctactttcttctgcttggctacacccagcatgtctgctatggctcgttttcgtgccttatctatcctcccagtattaccaactctaaatgacatgatgtgattgggtctacactttcatatcagagataaggagtagcacagttgcataaaaagcccaactctaatcagcttcttcctttcttgtaattagtacaaaggtgattagcgaaatctggaagcttagttggccctaaaaaaatcaaaaaaagcaaaaaacgaaaaacgaaaaaccacagttttgagaacagggaggtaacgaaggatcgtatatatatatatatatatatatacccacggatcccgagaccggcctttgattcttccctacaaccaaccattctcaccaccctaattcacaaccatggccaccatctccctgactaccgagcagctcctggaacaccccgagctcgttgccatcgacggagtcctgtacgatctcttcggtctggccaaggtccatgccggaggcaacctcatcgaagctgccggtgcatccgacggaaccgctctgttctactccatgcatcctggagtcaagccagagaactcgaagcttctgcagcaatttgcccgaggcaagcacgaacgaagctccaaggatcccgtgtacaccttcgactctccctttgctcaggacgtcaagcagtccgttcgagaggtcatgaagggtcgaaactggtacgccactcctggcttctggctgagaaccgcactcatcatcgcttgtactgccattggcgagtggtactggatcacaaccggagcagtgatgtggggtatctttactggatacttccactcgcagattggcttggccattcaacacgatgcttctcacggagccatcagcaaaaagccctgggtcaacgcctttttcgcttatggcatcgacgccattggttcctctcgttggatctggctgcagtcccacattatgcgacatcacacttacaccaaccagcatggcctcgacctggatgctgcctcggcagagccgttcatcttgttccactcctatcctgctaccaacgcctctcgaaagtggtaccaccgatttcaggcgtggtacatgtacatcgttctgggaatgtatggtgtctcgatggtgtacaatcccatgtacctcttcacaatgcagcacaacgacaccattcccgaggccacttctctcagaccaggcagctttttcaatcggcagcgagctttcgccgtttcccttcgactgctcttcatcttccgaaacgcctttcttccctggtacattgctggtgcctctcctctgctcaccattcttctggtgcccacggtcacaggcatcttcctcacctttgtgttcgttctgtcccataacttcgagggagccgaacggaccccagagaagaactgcaaggccaaacgagctaaggaaggcaaggaggtcagagacgtggaagaggatcgagtcgactggtaccgagcacaggccgagactgctgccacctacggtggcagcgtgggaatgatgcttacaggcggtctcaacctgcagatcgagcatcacttgtttccccgaatgtcctcttggcactatcccttcattcaagacaccgttcgggagtgttgcaagcgacatggcgtccgttacacatactatcctaccattctcgagaacatcatgtccactcttcgatacatgcagaaggtgggtgttgctcacaccattcaggatgcccaggagttctaagcggccgcatgtacatacaagattatttatagaaatgaatcgcgatcgaacaaagagtacgagtgtacgagtaggggatgatgataaaagtggaagaagttccgcatctttggatttatcaacgtgtaggacgatacttcctgtaaaaatgcaatgtctttaccataggttctgctgtagatgttattaactaccattaacatgtctacttgtacagttgcagaccagttggagtatagaatggtacacttaccaaaaagtgttgatggttgtaactacgatatataaaactgttgacgggatccccgctgatatgcctaaggaacaatcaaagaggaagatattaattcagaatgctagtatacagttagggat

SEQ ID NO: 97 - DNA, 14619 bp, Artificial Sequence
  Plasmid pZP2-85m98F
cgatggaagccggtagaaccgggctgcttgtgcttggagatggaagccggtagaaccgggctgcttggggggatttggggccgctgggctccaaagaggggtaggcatttcgttggggttacgtaattgcggcatttgggtcctgcgcgcatgtcccattggtcagaattagtccggataggagacttatcagccaatcacagcgccggatccacctgtaggttgggttgggtgggagcacccctccacagagtagagtcaaacagcagcagcaacatgatagttgggggtgtgcgtgttaaaggaaaaaaaagaagcttgggttatattcccgctctatttagaggttgcgggatagacgccgacggagggcaatggcgctatggaaccttgcggatatccatacgccgcggcggactgcgtccgaaccagctccagcagcgttttttccgggccattgagccgactgcgaccccgccaacgtgtcttggcccacgcactcatgtcatgttggtgttgggaggccactttttaagtagcacaaggcacctagctcgcagcaaggtgtccgaaccaaagaagcggctgcagtggtgcaaacggggcggaaacggcgggaaaaagccacgggggcacgaattgaggcacgccctcgaatttgagacgagtcacggccccattcgcccgcgcaatggctcgccaacgcccggtcttttgcaccacatcaggttaccccaagccaaacctttgtgttaaaaagcttaacatattataccgaacgtaggtttgggcgggcttgctccgtctgtccaaggcaacatttatataagggtctgcatcgccggctcaattgaatcttttttcttcttctcttctctatattcattcttgaattaaacacacatcaaccatggtcaagcgacccgctctgcctctcaccgtggacggtgtcacctacgacgtttctgcctggctcaaccaccatcccggaggtgccgacattatcgagaactaccgaggtcgggatgctaccgacgtcttcatggttatgcactccgagaacgccgtgtccaaactcagacgaatgcccatcatggaaccttcctctcccctgactccaacacctcccaagccaaactccgacgaacctcaggaggatttccgaaagctgcgagacgagctcattgctgcaggcatgttcgatgcctctcccatgtggtacgcttacaagaccctgtcgactctcggactgggtgtccttgccgtgctgttgatgacccagtggcactggtacctggttggtgctatcgtcctcggcattcactttcaacagatgggatggctctcgcacgacatttgccatcaccagctgttcaaggaccgatccatcaacaatgccattggcctgctcttcggaaacgtgcttcagggcttttctgtcacttggtggaaggaccgacacaacgctcatcactccgccaccaacgtgcagggtcacgatcccgacatcgacaacctgcctctcctggcgtggtccaaggaggacgtcgagcgagctggcccgttttctcgacggatgatcaagtaccaacagtattacttctttttcatctgtgcccttctgcgattcatctggtgctttcagtccattcatactgccacgggtctcaaggatcgaagcaatcagtactatcgaagacagtacgagaaggagtccgtcggtctggcactccactggggtctcaaggccttgttctactatttctacatgccctcgtttctcaccggactcatggtgttctttgtctccgagctgcttggtggcttcggaattgccatcgttgtcttcatgaaccactaccctctggagaagattcaggactccgtgtgggatggtcatggcttctgtgctggacagattcacgagaccatgaacgttcagcgaggcctcgtcacagactggtttttcggtggcctcaactaccagatcgaacatcacctgtggcctactcttcccagacacaacctcaccgctgcctccatcaaagtggagcagctgtgcaagaagcacaacctgccctaccgatctcctcccatgctcgaaggtgtcggcattcttatctcctacctgggcaccttcgctcgaatggttgccaaggcagacaaggcctaagcggccgcattgatgattggaaacacacacatgggttatatctaggtgagagttagttggacagttatatattaaatcagctatgccaacggtaacttcattcatgtcaacgaggaaccagtgactgcaagtaatatagaatttgaccaccttgccattctcttgcactcctttactatatctcatttatttcttatatacaaatcacttcttcttcccagcatcgagctcggaaacctcatgagcaataacatcgtggatctcgtcaatagagggctttttggactccttgctgttggccaccttgtccttgctgtttaaacatcgtggttaatgctgctgtgtgctgtgtgtgtgtgttgtttggcgctcattgttgcgttatgcagcgtacaccacaatattggaagcttattagcctttctattttttcgtttgcaaggcttaacaacattgctgtggagagggatggggatatggaggccgctggagggagtcggagaggcgttttggagcggcttggcctggcgcccagctcgcgaaacgcacctaggaccctttggcacgccgaaatgtgccacttttcagtctagtaacgccttacctacgtcattccatgcgtgcatgtttgcgccttttttcccttgcccttgatcgccacacagtacagtgcactgtacagtggaggttttgggggggtcttagatgggagctaaaagcggcctagcggtacactagtgggattgtatggagtggcatggagcctaggtggagcctgacaggacgcacgaccggctagcccgtgacagacgatgggtggctcctgttgtccaccgcgtacaaatgtttgggccaaagtcttgtcagccttgcttgcgaacctaattcccaattttgtcacttcgcacccccattgatcgagccctaacccctgcccatcaggcaatccaattaagctcgcattgtctgccttgtttagtttggctcctgcccgtttcggcgtccacttgcacaaacacaaacaagcattatatataaggctcgtctctccctcccaaccacactcacttttttgcccgtcttcccttgctaacacaaaagtcaagaacacaaacaaccaccccaacccccttacacacaagacatatctacagcaatggccatggctctctcccttactaccgagcagctgctcgagcgacccgacctggttgccatcgacggcattctctacgatctggaaggtcttgccaaggtccatcccggatccgacttgatcctcgcttctggtgcctccgatgcttctcctctgttctactccatgcacccttacgtcaagcccgagaactcgaagctgcttcaacagttcgtgcgaggcaagcacgaccgaacctccaaggacattgtctacacctacgactctccctttgcacaggacgtcaagcgaactatgcgagaggtcatgaaaggtcggaactggtatgccacacctggattctggctgcgaaccgttggcatcattgctgtcaccgccttttgcgagtggcactgggctactaccggaatggtgctgtggggtctcttgactggattcatgcacatgcagatcggcctgtccattcagcacgatgcctctcatggtgccatcagcaaaaagccctgggtcaacgctctctttgcctacggcatcgacgtcattggatcgtccagatggatctggctgcagtctcacatcatgcgacatcacacctacaccaatcagcatggtctcgacctggatgccgagtccgcagaaccattccttgtgttccacaactaccctgctgccaacactgctcgaaagtggtttcaccgattccaggcctggtacatgtacctcgtgcttggagcctacggcgtttcgctggtgtacaaccctctctacatcttccgaatgcagcacaacgacaccattcccgagtctgtcacagccatgcgagagaacggctttctgcgacggtaccgaacccttgcattcgttatgcgagctttcttcatctttcgaaccgccttcttgccctggtatctcactggaacctccctgctcatcaccattcctctggtgcccactgctaccggtgccttcctcaccttctttttcatcttgtctcacaacttcgatggctcggagcgaatccccgacaagaactgcaaggtcaagagctccgagaaggacgttgaagccgatcagatcgactggtacagagctcaggtggagacctcttccacctacggtggacccattgccatgttctttactggcggtctcaacttccagatcgagcatcacctctttcctcgaatgtcgtcttggcactatcccttcgtgcagcaagctgtccgagagtgttgcgaacgacacggagttcggtacgtcttctaccctaccattgtgggcaacatcatttccaccctcaagtacatgcacaaagtcggtgtggttcactgtgtcaaggacgctcaggattcctaagcggccgcatgagaagataaatatataaatacattgagatattaaatgcgctagattagagagcctcatactgctcggagagaagccaagacgagtactcaaaggggattacaccatccatatccacagacacaagctggggaaaggttctatatacactttccggaataccgtagtttccgatgttatcaatgggggcagccaggatttcaggcacttcggtgtctcggggtgaaatggcgttcttggcctccatcaagtcgtaccatgtcttcatttgcctgtcaaagtaaaacagaagcagatgaagaatgaacttgaagtgaaggaatttaaatgtaacgaaactgaaatttgaccagatattgtgtccgcggtggagctccagcttttgttccctttagtgagggttaatttcgagcttggcgtaatcatggtcatagctgtttcctgtgtgaaattgttatccgctcacaagcttccacacaacgtacgggcgtcgttgcttgtgtgatttttgaggacccatccctttggtatataagtatactctggggttaaggttgcccgtgtagtctaggttatagttttcatgtgaaataccgagagccgagggagaataaacgggggtatttggacttgtttttttcgcggaaaagcgtcgaatcaaccctgcgggccttgcaccatgtccacgacgtgtttctcgccccaattcgccccttgcacgtcaaaattaggcctccatctagacccctccataacatgtgactgtggggaaaagtataagggaaaccatgcaaccatagacgacgtgaaagacggggaggaaccaatggaggccaaagaaatggggtagcaacagtccaggagacagacaaggagacaaggagagggcgcccgaaagatcggaaaaacaaacatgtccaattggggcagtgacggaaacgacacggacacttcagtacaatggaccgaccatctccaagccagggttattccggtatcaccttggccgtaacctcccgctggtacctgatattgtacacgttcacattcaatatactttcagctacaataagagaggctgtttgtcgggcatgtgtgtccgtcgtatggggtgatgtccgagggcgaaattcgctacaagcttaactctggcgcttgtccagtatgaatagacaagtcaagaccagtggtgccatgattgacagggaggtacaagacttcgatactcgagcattactcggacttgtggcgattgaacagacgggcgatcgcttctcccccgtattgccggcgcgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgatgcggtgtgaaataccgcacagatgcgtaaggagaaaataccgcatcaggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggcccgacgtcgcatgcgctgatgacactttggtctgaaagagatgcattttgaatcccaaacttgcagtgcccaagtgacatacatctccgcgttttggaaaatgttcagaaacagttgattgtgttggaatggggaatggggaatggaaaaatgactcaagtatcaattccaaaaacttctctggctggcagtacctactgtccatactactgcattttctccagtcaggccactctatactcgacgacacagtagtaaaacccagataatttcgacataaacaagaaaacagacccaataatatttatatatagtcagccgtttgtccagttcagactgtaatagccgaaaaaaaatccaaagtttctattctaggaaaatatattccaatatttttaattcttaatctcatttattttattctagcgaaatacatttcagctacttgagacatgtgatacccacaaatcggattcggactcggttgttcagaagagcatatggcattcgtgctcgcttgttcacgtattcttcctgttccatctcttggccgacaatcacacaaaaatggggttttttttttaattctaatgattcattacagcaaaattgagatatagcagaccacgtattccataatcaccaaggaagttcttgggcgtcttaattaactcacctgcaggattgagactatgaatggattcccgtgcccgtattactctactaatttgatcttggaacgcgaaaatacgtttctaggactccaaagaatctcaactcttgtccttactaaatatactacccatagttgatggtttacttgaacagagaggacatgttcacttgacccaaagtttctcgcatctcttggatatttgaacaacggcgtccactgaccgtcagttatccagtcacaaaacccccacattcatacattcccatgtacgtttacaaagttctcaattccatcgtgcaaatcaaaatcacatctattcattcatcatatataaacccatcatgtctactaacactcacaactccatagaaaacatcgactcagaacacacgctccatgcggccgcttactgagccttggcaccgggctgcttctcggccattcgagcgaactgggacaggtatcggagcaggatgacgagaccttcatggggcagagggtttcggtaggggaggttgtgcttctggcacagctgttccacctggtaggaaacggcagtgaggttgtgtcgaggcagggtgggccagagatggtgctcgatctggtagttcaggcctccaaagaaccagtcagtaatgatgcctcgtcgaatgttcatggtctcatggatctgacccacagagaagccatgtccgtcccagacggaatcaccgatcttctccagagggtagtggttcatgaagaccacgatggcaattccgaagccaccgacgagctcggaaacaaagaacaccagcatcgaggtcaggatggagggcataaagaagaggtggaacagggtcttgagagtccagtgcagagcgagtccaatggcctctttcttgtactgagatcggtagaactggttgtctcggtccttgagggatcgaacggtcagcacagactggaaacaccagatgaatcgcaggagaatacagatgaccaggaaatagtactgttggaactgaatgagctttcgggagatgggagaagctcgagtgacatcgtcctcggaccaggcgagcagaggcaggttatcaatgtcgggatcgtgaccctgaacgttggtagcagaatgatgggcgttgtgtctgtccttccaccaggtcacggagaagccctggagtccgttgccaaagaccagacccaggacgttattccagtttcggttcttgaaggtctggtggtggcagatgtcatgagacagccatcccatttgctggtagtgcataccgagcacgagagcaccaatgaagtacaggtggtactggaccagcatgaagaaggcaagcacgccaagacccagggtggtcaagatcttgtacgagtaccagaggggagaggcgtcaaacatgccagtggcgatcagctcttctcggagctttcggaaatcctcctgagcttcgttgacggcagcctggggaggcagctcggaagcctggttgatcttgggcattcgcttgagcttgtcgaaggcttcctgagagtgcataaccatgaaggcgtcagtagcatctcgtccctggtagttctcaatgatttcagctccaccagggtggaagttcacccaagcggagacgtcgtacacctttccgtcgatgacgaggggcagagcctgtcgagaagccttcacggatcccatgacggccagagagtcgtagtaggtagcgggaggaagtccggcaggtcgagcgggaccggcgccctgaatctttttggctcccttgtgctttcggacgatgtaggtctgcacgtagaagttgaggaacagacacaggacagtaccaacgtagaagtagttgaaaaaccagccaaacattctcattccatcttgtcggtagcagggaatgttccggtacttccagacgatgtagaagccaacgttgaactgaatgatctgcatagaagtaatcagggacttgggcatagggaacttgagcttgatcagtcgggtccaatagtagccgtacatgatccagtgaatgaagccgttgagcagcacaaagatccaaacggcttcgtttcggtagttgtagaacagccacatgtccataggagctccgagatggtgaaagaactgcaaccaggtcagaggcttgcccatgaggggcagatagaaggagtcaatgtactcgaggaacttgctgaggtagaacagctgagtggtgattcggaagacattgttgtcgaaagccttctcgcagttgtcggacatgacaccaatggtgtacatggcgtaggccatagagaggaaggagcccagcgagtagatggacatgagcaggttgtagttggtgaacacaaacttcattcgagactgacccttgggtccgagaggaccaagggtgaacttcaggatgacgaaggcgatggagaggtacagcacctcgcagtgcgaggcatcagaccagagctgagcatagtcgaccttgggaagaacctcctggccaatggagacgatttcgttcacgacctccatggttgtgaattagggtggtgagaatggttggttgtagggaagaatcaaaggccggtctcgggatccgtgggtatatatatatatatatatatatacgatccttcgttacctccctgttctcaaaactgtggtttttcgtttttcgttttttgctttttttgatttttttagggccaactaagcttccagatttcgctaatcacctttgtactaattacaagaaaggaagaagctgattagagttgggctttttatgcaactgtgctactccttatctctgatatgaaagtgtagacccaatcacatcatgtcatttagagttggtaatactgggaggatagataaggcacgaaaacgagccatagcagacatgctgggtgtagccaagcagaagaaagtagatgggagccaattgacgagcgagggagctacgccaatccgacatacgacacgctgagatcgtcttggccggggggtacctacagatgtccaagggtaagtgcttgactgtaattgtatgtctgaggacaaatatgtagtcagccgtataaagtcataccaggcaccagtgccatcatcgaaccactaactctctatgatacatgcctccggtattattgtaccatgcgtcgctttgttacatacgtatcttgcctttttctctcagaaactccagaattctctctcttgagcttttccataacaagttcttctgcctccaggaagtccatgggtggtttgatcatggttttggtgtagtggtagtgcagtggtggtattgtgactggggatgtagttgagaataagtcatacacaagtcagctttcttcgagcctcatataagtataagtagttcaacgtattagcactgtacccagcatctccgtatcgagaaacacaacaacatgccccattggacagatcatgcggatacacaggttgtgcagtatcatacatactcgatcagacaggtcgtctgaccatcatacaagctgaacaagcgctccatacttgcacgctctctatatacacagttaaattacatatccatagtctaacctctaacagttaatcttctggtaagcctcccagccagccttctggtatcgcttggcctcctcaataggatctcggttctggccgtacagacctcggccgacaattatgatatccgttccggtagacatgacatcctcaacagttcggtactgctgtccgagagcgtctcccttgtcgtcaagacccaccccgggggtcagaataagccagtcctcagagtcgcccttaggtcggttctgggcaatgaagccaaccacaaactcggggtcggatcgggcaagctcaatggtctgcttggagtactcgccagtggccagagagcccttgcaagacagctcggccagcatgagcagacctctggccagcttctcgttgggagaggggactaggaactccttgtactgggagttctcgtagtcagagacgtcctccttcttctgttcagagacagtttcctcggcaccagctcgcaggccagcaatgattccggttccgggtacaccgtgggcgttggtgatatcggaccactcggcgattcggtgacaccggtactggtgcttgacagtgttgccaatatctgcgaactttctgtcctcgaacaggaagaaaccgtgcttaagagcaagttccttgagggggagcacagtgccggcgtaggtgaagtcgtcaatgatgtcgatatgggttttgatcatgcacacataaggtccgaccttatcggcaagctcaatgagctccttggtggtggtaacatccagagaagcacacaggttggttttcttggctgccacgagcttgagcactcgagcggcaaaggcggacttgtggacgttagctcgagcttcgtaggagggcattttggtggtgaagaggagactgaaataaatttagtctgcagaactttttatcggaaccttatctggggcagtgaagtatatgttatggtaatagttacgagttagttgaacttatagatagactggactatacggctatcggtccaaattagaaagaacgtcaatggctctctgggcgtcgcctttgccgacaaaaatgtgatcatgatgaaagccagcaatgacgttgcagctgatattgttgtcggccaaccgcgccgaaaacgcagctgtcagacccacagcctccaacgaagaatgtatcgtcaaagtgatccaagcacactcatagttggagtcgtactccaaaggcggcaatgacgagtcagacagatactcgtcgaccttttccttgggaaccaccaccgtcagcccttctgactcacgtattgtagccaccgacacaggcaacagtccgtggatagcagaatatgtcttgtcggtccatttctcaccaactttaggcgtcaagtgaatgttgcagaagaagtatgtgccttcattgagaatcggtgttgctgatttcaataaagtcttgagatcagtttggccagtcatgttgtggggggtaattggattgagttatcgcctacagtctgtacaggtatactcgctgcccactttatactttttgattccgctgcacttgaagcaatgtcgtttaccaaaagtgagaatgctccacagaacacaccccagggtatggttgagcaaaaaataaacactccgatacggggaatcgaaccccggtctccacggttctcaagaagtattcttgatgagagcgtat

SEQ ID NO: 98 - DNA, 993 bp, Artificial Sequence
  993 bp stuffer fragment
ctctatccaatcacacagtcaactccgactaccacgctccggcgggcagtggagccttctactctcaccagaatggctctgagcgcgacatgccaccgcccgccacgtcctaccgaggataccagcctccgggatattgaaaaaaaagtgtaaatatttattatcgtcaatcgatcacgaattatctgaacggaatgaatgcagccgtgtgtgagctgtgtagatcatgtaacgtaaacggatacaatggctccatcctttcttgactcgtttccacttctgcaattgagtcgtaggaggtgatctcactcatgatcatgacttgtgcactaacgttggctctacagaatagtcagaatagtccagctcgtgccagtcgcgtgatttgaaacgcgaccaacaatgagaatgtttcataagctgcgctaagttggtgatgtctcacattcacattcgtttcatgacgcgatcaaacttgtctacagttacctattgcgaaacaaaactgcgggacagtttcttctatcatctataaatcattaatttatacaatccgtatccgacggattcgtttttcccattctttttgtctgcgtctccgtctaagcgagagaagtgaagaacttgtgggcgagctcgagcggccgcattctagatgcagacgcaccttgaccagatcaaacggatgaccaaccagaacggcgcagatacctccaaagccaccggcggcgaaggactcggcctgcgacaggaacgacttgagagcggaagggggagcgatggccttaacgccagagtcaatttcgggagcgtcactcattgtgtggggtgtgtggaagggatagttgagtgcagttaggagatggcaacgtccgagttataagaagtgtttagagttgttcacacgggaaggttacctcggcatgtgaatatggaggattcggtataggggggtgtagcggcgggtttagggggcgattgtgtatatatatg

SEQ ID NO: 99 - DNA, 7338 bp, Artificial Sequence
  Plasmid pYPS234
aaatgagtatctgtctgactcgtcattgccgcctttggagtacgactccaactatgagtgtgcttggatcactttgacgatacattcttcgttggaggctgtgggtctgacagctgcgttttcggcgcggttggccgacaacaatatcagctgcaacgtcattgctggctttcatcatgatcacatttttgtcggcaaaggcgacgcccagagagccattgacgttctttctaatttggaccgatagccgtatagtccagtctatctataagttcaactaactcgtaactattaccataacatatacttcactgccccagataaggttccgataaaaagttctgcagactaaatttatttcagtctcctcttcaccaccaaaatgccctcctacgaagctcgagctaacgtccacaagtccgcctttgccgctcgagtgctcaagctcgtggcagccaagaaaaccaacctgtgtgcttctctggatgttaccaccaccaaggagctcattgagcttgccgataaggtcggaccttatgtgtgcatgatcaaaacccatatcgacatcattgacgacttcacctacgccggcactgtgctccccctcaaggaacttgctcttaagcacggtttcttcctgttcgaggacagaaagttcgcagatattggcaacactgtcaagcaccagtaccggtgtcaccgaatcgccgagtggtccgatatcaccaacgcccacggtgtacccggaaccggaatcattgctggcctgcgagctggtgccgaggaaactgtctctgaacagaagaaggaggacgtctctgactacgagaactcccagtacaaggagttcctagtcccctctcccaacgagaagctggccagaggtctgctcatgctggccgagctgtcttgcaagggctctctggccactggcgagtactccaagcagaccattgagcttgcccgatccgaccccgagtttgtggttggcttcattgcccagaaccgacctaagggcgactctgaggactggcttattctgacccccggggtgggtcttgacgacaagggagacgctctcggacagcagtaccgaactgttgaggatgtcatgtctaccggaacggatatcataattgtcggccgaggtctgtacggccagaaccgagatcctattgaggaggccaagcgataccagaaggctggctgggaggcttaccagaagattaactgttagaggttagactatggatatgtaatttaactgtgtatatagagagcgtgcaagtatggagcgcttgttcagcttgtatgatggtcagacgacctgtctgatcgagtatgtatgatactgcacaacctgtgtatccgcatgatctgtccaatggggcatgttgttgtgtttctcgatacggagatgctgggtacagtgctaatacgttgaactacttatacttatatgaggctcgaagaaagctgacttgtgtatgacttaattaacgcggcgcgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgatgcggtgtgaaataccgcacagatgcgtaaggagaaaataccgcatcaggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggcccgacgtcgcatgcatcaatcgatgactgtcgactcacgtacgggtggtgagaatggttggttgtagggaagaatcaaaggccggtctcgggatccgtgggtatatatatatatatatatatatacgatccttcgttacctccctgttctcaaaactgtggtttttcgtttttcgttttttgctttttttgatttttttagggccaactaagcttccagatttcgctaatcacctttgtactaattacaagaaaggaagaagctgattagagttgggctttttatgcaactgtgctactccttatctctgatatgaaagtgtagacccaatcacatcatgtcatttagagttggtaatactgggaggatagataaggcacgaaaacgagccatagcagacatgctgggtgtagccaagcagaagaaagtagatgggagccaattgacgagcgagggagctacgccaatccgacatacgacacgctgagatcgtcttggccggggggtacctacagatgtccaagggtaagtgcttgactgtaattgtatgtctgaggacaaatatgtagtcagccgtataaagtcataccaggcaccagtgccatcatcgaaccactaactctctatgatacatgcctccggtattattgtaccatgcgtcgctttgttacatacgtatcttgcctttttctctcagaaactccagactttggctattggtcgagataagcccggaccatagtgagtctttcacactctgtttaaacaagctaccaccacactcgttgggtgcagtcgccagcttaaagatatctatccacatcagccacaactcccttcctttaataaaccgactacacccttggctattgaggttatgagtgaatatactgtagacaagacactttcaagaagactgtttccaaaacgtaccactgtcctccactacaaacacacccaatctgcttcttctagtcaaggttgctacaccggtaaattataaatcatcatttcattagcagggcagggccctttttatagagtcttatacactagcggaccctgccggtagaccaacccgcaggcgcgtcagtttgctccttccatcaatgcgtcgtagactagtctctatccaatcacacagtcaactccgactaccacgctccggcgggcagtggagccttctactctcaccagaatggctctgagcgcgacatgccaccgcccgccacgtcctaccgaggataccagcctccgggatattgaaaaaaaagtgtaaatatttattatcgtcaatcgatcacgaattatctgaacggaatgaatgcagccgtgtgtgagctgtgtagatcatgtaacgtaaacggatacaatggctccatcctttcttgactcgtttccacttctgcaattgagtcgtaggaggtgatctcactcatgatcatgacttgtgcactaacgttggctctacagaatagtcagaatagtccagctcgtgccagtcgcgtgatttgaaacgcgaccaacaatgagaatgtttcataagctgcgctaagttggtgatgtctcacattcacattcgtttcatgacgcgatcaaacttgtctacagttacctattgcgaaacaaaactgcgggacagtttcttctatcatctataaatcattaatttatacaatccgtatccgacggattcgtttttcccattctttttgtctgcgtctccgtctaagcgagagaagtgaagaacttgtgggcgagctcgagcggccgcattctagatgcagacgcaccttgaccagatcaaacggatgaccaaccagaacggcgcagatacctccaaagccaccggcggcgaaggactcggcctgcgacaggaacgacttgagagcggaagggggagcgatggccttaacgccagagtcaatttcgggagcgtcactcattgtgtggggtgtgtggaagggatagttgagtgcagttaggagatggcaacgtccgagttataagaagtgtttagagttgttcacacgggaaggttacctcggcatgtgaatatggaggattcggtataggggggtgtagcggcgggtttagggggcgattgtgtatatatatgggatcccggttctgtgtgcacaattggcaatccaagatggatggattcaacacagggatatagcgagctacgtggtggtgcgaggatatagcaacggatatttatgtttgacacttgagaatgtacgatacaagcactgtccaagtacaatactaaacatactgtacatactcatactcgtacccgggcaacggtttcacttgagtgcagtggctagtgctcttactcgtacagtgtgcaatactgcgtatcatagtctttgatgtatatcgtattcattcatgttagttgcgtacgctgtgttgttgtatgtggtgaagcttgacaatggatggtgtgtcgtatcaggctggggaacaattgtgcttaagtatgctgcagttgagtaagagtcatcgctccaccaaaataaagtttgccattagggttggagagagagatggtggctggaagaattaaatgacatcaagctgaggattgtgggtgtgcaataacacatgttaggggtgacctgtggctcgaaatctgataattattttgtaactttatgattattcttagattttttaatattcctctatataacacataagtagctgtcgtctagttgttcatagcctgactcctgcaatagattagtgcagagtgattttgtgcaattgagagccacggttgagtcaagtgactttgtgtgtgaagtcatcttacgtttcaagtctcacaggttactcaattggttggttgtctgccctttacagatatttacagtacctgagcgtaaagtcgttcatccacggaatgactgttcctgtcacgcagtcatgatcatggatgtggctggtcaggaaccattttggataggagacttagggattggactattattgaaaaaactgagccgaatatgatatagttctatttgaatgcagaacttctgatggtcaattcacttatttcaggcatatcggtcatggtggcagctgccacgatgttatctcgttggaaaagatcttcgattt

SEQ ID NO: 100 - DNA, 1019 bp, Artificial Sequence
  1019 bp stuffer fragment
actcactctgtcagctgccccacattgcccaatgcacaatgcacaatgatgtgtgcaaacaacgcaatcaaaagtctatgcatgctgaccaaactctgatcaccaagttgcgaacatgaaaaagaagacctgtgtatatataagtaagggggagagccctaactagatctttcgaaaaccccccgaccttcaccttccacaaccatgatcatcttatacgttttggccgttgcggtctccttcctcatcttcaagagagtcacctacacgatgcgaagccgagagctcgccaagaagtggcactgtgaggagcctcacaacctgaatgatctagatagcggccgccatcttaacggtgtgttcgttaagatgacccgggacgaggctgcctttgccgagaccgagaagctcattaacgcataaagggatgtatacttgtactgtagatggattaataaattatttatgatgaacaaacattgactgagaaaggcaccatattgtagcttcaagtactgtactggtagaagtaagcctgtcgttacccacttatggagatccaatattgtttgatgcggccatcggactgcttggagcgtacagagaattggtaaaatgtggtggctgggttggtttcgattgaaattatcaagatctctgaggtattcttggtgttgaagggatgttcttggactactgcttgtaacatagatgggatgtagggatggcatggggtataatcgagacaaccattgtggaggtaggcaagagctcttacaagtaccatacgagtacaactactgaggcataatgtctggaattcccggttaagtccattacagttgatatcattcaaatcggacagatattctccgaggtgatacatctctgtccccgagagaagctgatttggagcacatccaggttacggggggagagaaatttatgtaatgtgaggattttttggagctgaataataaagtcctgttgatctagcttcaattgagtcaacatccgcc

SEQ ID NO: 101 - DNA, 7364 bp, Artificial Sequence
  Plasmid pYPS233
aaatgagtatctgtctgactcgtcattgccgcctttggagtacgactccaactatgagtgtgcttggatcactttgacgatacattcttcgttggaggctgtgggtctgacagctgcgttttcggcgcggttggccgacaacaatatcagctgcaacgtcattgctggctttcatcatgatcacatttttgtcggcaaaggcgacgcccagagagccattgacgttctttctaatttggaccgatagccgtatagtccagtctatctataagttcaactaactcgtaactattaccataacatatacttcactgccccagataaggttccgataaaaagttctgcagactaaatttatttcagtctcctcttcaccaccaaaatgccctcctacgaagctcgagctaacgtccacaagtccgcctttgccgctcgagtgctcaagctcgtggcagccaagaaaaccaacctgtgtgcttctctggatgttaccaccaccaaggagctcattgagcttgccgataaggtcggaccttatgtgtgcatgatcaaaacccatatcgacatcattgacgacttcacctacgccggcactgtgctccccctcaaggaacttgctcttaagcacggtttcttcctgttcgaggacagaaagttcgcagatattggcaacactgtcaagcaccagtaccggtgtcaccgaatcgccgagtggtccgatatcaccaacgcccacggtgtacccggaaccggaatcattgctggcctgcgagctggtgccgaggaaactgtctctgaacagaagaaggaggacgtctctgactacgagaactcccagtacaaggagttcctagtcccctctcccaacgagaagctggccagaggtctgctcatgctggccgagctgtcttgcaagggctctctggccactggcgagtactccaagcagaccattgagcttgcccgatccgaccccgagtttgtggttggcttcattgcccagaaccgacctaagggcgactctgaggactggcttattctgacccccggggtgggtcttgacgacaagggagacgctctcggacagcagtaccgaactgttgaggatgtcatgtctaccggaacggatatcataattgtcggccgaggtctgtacggccagaaccgagatcctattgaggaggccaagcgataccagaaggctggctgggaggcttaccagaagattaactgttagaggttagactatggatatgtaatttaactgtgtatatagagagcgtgcaagtatggagcgcttgttcagcttgtatgatggtcagacgacctgtctgatcgagtatgtatgatactgcacaacctgtgtatccgcatgatctgtccaatggggcatgttgttgtgtttctcgatacggagatgctgggtacagtgctaatacgttgaactacttatacttatatgaggctcgaagaaagctgacttgtgtatgacttaattaacgcggcgcgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgatgcggtgtgaaataccgcacagatgcgtaaggagaaaataccgcatcaggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggcccgacgtcgcatgcattccatagccacacctttgcctatggcttcacaaccgaaggcaattcgagaggtcgcgcttatggaatcgactcgtataaagctgaagggaaagggagacgttccgagcgctcagatgcaatagtcgtccagctaatgtggattcaaaaacaaccccaacagtaatcttgaaaatttgaacggatcaatctgaacactcttgctccaggtcattcttctaacgcacatccccagagtctagagggagttgtgttgtgaacatcctaataaacaatgcaatggattcgggatatcttctgtctcgccccctactcgatgtcgagtaaaccgatcaccaactaacaatactcctccgcgttctgccattgactctcaaacagacatcgctatcaacggaacagcatattttagcttcttaggacaataaatattgataatgccggctctccctcggtatattaagcaatccattcatacactcattcatcaggttaattttatatatataatttgtctattcaaacaccgtaaattactggtaccatcatctcctccttttcaaatacacgtctatttgcattaatgaaattactcgccaattcgcagaacgtgtttgtcgaacagagccttagctcgggtccagacaggagcagtgtctcgctgaggaagctgcaggagagttaattaaaaggcgttgaaacagaatgagccagacagcaaggacaaggtggccaacagcaaggagtccaaaaagccctctattgacgagatccacgatgttattgctcatgaggtttccgagctcgatgctgggaagaagaagtgatttgtatataagaaataaatgagatatagtaaaggagtgcaagagaatggcaaggtggtcaaattctatattacttgcagtcactggttcctcgttgacatgaatgaagttaccgttggcatagctgatttaatatataactgtccaactaactctcacctagatataacccatgtgtgtgtttccacgcgtactcactctgtcagctgccccacattgcccaatgcacaatgcacaatgatgtgtgcaaacaacgcaatcaaaagtctatgcatgctgaccaaactctgatcaccaagttgcgaacatgaaaaagaagacctgtgtatatataagtaagggggagagccctaactagatctttcgaaaaccccccgaccttcaccttccacaaccatgatcatcttatacgttttggccgttgcggtctccttcctcatcttcaagagagtcacctacacgatgcgaagccgagagctcgccaagaagtggcactgtgaggagcctcacaacctgaatgatctagatagcggccgccatcttaacggtgtgttcgttaagatgacccgggacgaggctgcctttgccgagaccgagaagctcattaacgcataaagggatgtatacttgtactgtagatggattaataaattatttatgatgaacaaacattgactgagaaaggcaccatattgtagcttcaagtactgtactggtagaagtaagcctgtcgttacccacttatggagatccaatattgtttgatgcggccatcggactgcttggagcgtacagagaattggtaaaatgtggtggctgggttggtttcgattgaaattatcaagatctctgaggtattcttggtgttgaagggatgttcttggactactgcttgtaacatagatgggatgtagggatggcatggggtataatcgagacaaccattgtggaggtaggcaagagctcttacaagtaccatacgagtacaactactgaggcataatgtctggaattcccggttaagtccattacagttgatatcattcaaatcggacagatattctccgaggtgatacatctctgtccccgagagaagctgatttggagcacatccaggttacggggggagagaaatttatgtaatgtgaggattttttggagctgaataataaagtcctgttgatctagcttcaattgagtcaacatccgccgtcgactgacgtacgggtggtgagaatggttggttgtagggaagaatcaaaggccggtctcgggatccgtgggtatatatatatatatatatatatacgatccttcgttacctccctgttctcaaaactgtggtttttcgtttttcgttttttgctttttttgatttttttagggccaactaagcttccagatttcgctaatcacctttgtactaattacaagaaaggaagaagctgattagagttgggctttttatgcaactgtgctactccttatctctgatatgaaagtgtagacccaatcacatcatgtcatttagagttggtaatactgggaggatagataaggcacgaaaacgagccatagcagacatgctgggtgtagccaagcagaagaaagtagatgggagccaattgacgagcgagggagctacgccaatccgacatacgacacgctgagatcgtcttggccggggggtacctacagatgtccaagggtaagtgcttgactgtaattgtatgtctgaggacaaatatgtagtcagccgtataaagtcataccaggcaccagtgccatcatcgaaccactaactctctatgatacatgcctccggtattattgtaccatgcgtcgctttgttacatacgtatcttgcctttttctctcagaaactccagactttggctattggtcgagataagcccggaccatagtgagtctttcacactctgtttaaacaagctaccaccacactcgttgggtgcagtcgccagcttaaagatatctatccacatcagccacaactcccttcctttaataaaccgactacacccttggctattgaggttatgagtgaatatactgtagacaagacactttcaagaagactgtttccaaaacgtaccactgtcctccactacaaacacacccaatctgcttcttctagtcaaggttgctacaccggtaaattataaatcatcatttcattagcagggcagggccctttttatagagtcttatacactagcggaccctgccggtagaccaacccgcaggcgcgtcagtttgctccttccatcaatgcgtcgtagactagttcagatctcgattt

SEQ ID NO: 102 - DNA, 9211 bp, Artificial Sequence
  Plasmid pYPS241
cgatgactgtcgactccaacttttcacactgagcgtaaaatgtggagaagaaatcggcactaaaaagtcaggtagactggaaaatgcgccatgaaatgaatatctcttgctacagtaatgcccagcatcgaggggtattgtgtcaccaacactatagtggcagctgaagcgctcgtgattgtagtatgagtctttattggtgatgggaagagttcactcaatattctcgttactgccaaaacaccacggtaatcggccagacaccatggatgtagatcaccaagcctgtgaatgttattcgagctaaaatgcacatggttggtgaaaggagtagttgctgtcgaattccgtcgtcgcctgagtcatcatttatttaccagttggccacaaacccttgacgatctcgtatgtcccctccgacatactcccggccggctggggtacgttcgatagcgctatcggcatcgacaaggtttgggtccctagccgataccgcactacctgagtcacaatcttcggaggtttagtcttccacatagcacgggcaaaagtgcgtatatatacaagagcgtttgccagccacagattttcactccacacaccacatcacacatacaaccacacacatccacaatggaacccgaaactaagaagaccaagactgactccaagaagattgttcttctcggcggcgacttctgtggccccgaggtgattgccgaggccgtcaaggtgctcaagtctgttgctgaggcctccggcaccgagtttgtgtttgaggaccgactcattggaggagctgccattgagaaggagggcgagcccatcaccgacgctactctcgacatctgccgaaaggctgactctattatgctcggtgctgtcggaggcgctgccaacaccgtatggaccactcccgacggacgaaccgacgtgcgacccgagcagggtctcctcaagctgcgaaaggacctgaacctgtacgccaacctgcgaccctgccagctgctgtcgcccaagctcgccgatctctcccccatccgaaacgttgagggcaccgacttcatcattgtccgagagctcgtcggaggtatctactttggagagcgaaaggaggatgacggatctggcgtcgcttccgacaccgagacctactccgttcctgaggttgagcgaattgcccgaatggccgccttcctggcccttcagcacaacccccctcttcccgtgtggtctcttgacaaggccaacgtgctggcctcctctcgactttggcgaaagactgtcactcgagtcctcaaggacgaattcccccagctcgagctcaaccaccagctgatcgactcggccgccatgatcctcatcaagcagccctccaagatgaatggtatcatcatcaccaccaacatgtttggcgatatcatctccgacgaggcctccgtcatccccggttctctgggtctgctgccctccgcctctctggcttctctgcccgacaccaacgaggcgttcggtctgtacgagccctgtcacggatctgcccccgatctcggcaagcagaaggtcaaccccattgccaccattctgtctgccgccatgatgctcaagttctctcttaacatgaagcccgccggtgacgctgttgaggctgccgtcaaggagtccgtcgaggctggtatcactaccgccgatatcggaggctcttcctccacctccgaggtcggagacttgttgccaacaaggtcaaggagctgctcaagaaggagtaagtcgtttctacgacgcattgatggaaggagcaaactgacgcgcctgcgggttggtctaccggcagggtccgctagtgtataagactctataaaaagggccctgccctgctaatgaaatgatgatttataatttaccggtgtagcaaccttgactagaagaagcagattgggtgtgtttgtagtggaggacagtggtacgttttggaaacagtcttcttgaaagtgtcttgtctacagtatattcactcataacctcaatagccaagggtgtagtcggtttattaaaggaagggagttgtggctgatgtggatagatatctttaagctggcgactgcacccaacgagtgtggtggtagcttgtttaaacggtaggttagtgcttggtatatgagttgtaggcatgacaatttggaaaggggtggactttgggaatattgtgggatttcaataccttagtttgtacgcaactaacatgaatgaatacgatatacatcaaagactatgatacgcagtattgcacactgtacgagtaagagcactagccactgcactcaagtgaaaccgttgcccgggtacgagtatgagtatgtacagtatgtttagtattgtacttggacagtgcttgtatcgtacattctcaagtgtcaaacataaatatccgttgctatatcctcgcaccaccacgtagctcgctatatccctgtgttgaatccatccatcttggattgccaattgtgcacacagaaccgggcactcacttccccatccacacttgcggccgcttaggccttgtctgccttggcaaccattcgagcgaaggtgcccaggtaggagataagaatgccgacaccttcgagcatgggaggagatcggtagggcaggttgtgcttcttgcacagctgctccactttgatggaggcagcggtgaggttgtgtctgggaagagtaggccacaggtgatgttcgatctggtagttgaggccaccgaaaaaccagtctgtgacgaggcctcgctgaacgttcatggtctcgtgaatctgtccagcacagaagccatgaccatcccacacggagtcctgaatcttctccagagggtagtggttcatgaagacaacgatggcaattccgaagccaccaagcagctcggagacaaagaacaccatgagtccggtgagaaacgagggcatgtagaaatagtagaacaaggccttgagaccccagtggagtgccagaccgacggactccttctcgtactgtcttcgatagtactgattgcttcgatccttgagacccgtggcagtatgaatggactgaaagcaccagatgaatcgcagaagggcacagatgaaaaagaagtaatactgttggtacttgatcatccgtcgagaaaacgggccagctcgctcgacgtcctccttggaccacgccaggagaggcaggttgtcgatgtcgggatcgtgaccctgcacgttggtggcggagtgatgagcgttgtgtcggtccttccaccaagtgacagaaaagccctgaagcacgtttccgaagagcaggccaatggcattgttgatggatcggtccttgaacagctggtgatggcaaatgtcgtgcgagagccatcccatctgttgaaagtgaatgccgaggacgatagcaccaaccaggtaccagtgccactgggtcatcaacagcacggcaaggacacccagtccgagagtcgacagggtcttgtaagcgtaccacatgggagaggcatcgaacatgcctgcagcaatgagctcgtctcgcagctttcggaaatcctcctgaggttcgtcggagtttggcttgggaggtgttggagtcaggggagaggaaggttccatgatgggcattcgtctgagtttggacacggcgttctcggagtgcataaccatgaagacgtcggtagcatcccgacctcggtagttctcgataatgtcggcacctccgggatggtggttgagccaggcagaaacgtcgtaggtgacaccgtccacggtgagaggcagagcgggtcgcttgaccatggttgatgtgtgtttaattcaagaatgaatatagagaagagaagaagaaaaaagattcaattgagccaaaccgatttaaatgagtatctgtctgactcgtcattgccgcctttggagtacgactccaactatgagtgtgcttggatcactttgacgatacattcttcgttggaggctgtgggtctgacagctgcgttttcggcgcggttggccgacaacaatatcagctgcaacgtcattgctggctttcatcatgatcacatttttgtcggcaaaggcgacgcccagagagccattgacgttctttctaatttggaccgatagccgtatagtccagtctatctataagttcaactaactcgtaactattaccataacatatacttcactgccccagataaggttccgataaaaagttctgcagactaaatttatttcagtctcctcttcaccaccaaaatgccctcctacgaagctcgagctaacgtccacaagtccgcctttgccgctcgagtgctcaagctcgtggcagccaagaaaaccaacctgtgtgcttctctggatgttaccaccaccaaggagctcattgagcttgccgataaggtcggaccttatgtgtgcatgatcaaaacccatatcgacatcattgacgacttcacctacgccggcactgtgctccccctcaaggaacttgctcttaagcacggtttcttcctgttcgaggacagaaagttcgcagatattggcaacactgtcaagcaccagtaccggtgtcaccgaatcgccgagtggtccgatatcaccaacgcccacggtgtacccggaaccggaatcattgctggcctgcgagctggtgccgaggaaactgtctctgaacagaagaaggaggacgtctctgactacgagaactcccagtacaaggagttcctagtcccctctcccaacgagaagctggccagaggtctgctcatgctggccgagctgtcttgcaagggctctctggccactggcgagtactccaagcagaccattgagcttgcccgatccgaccccgagtttgtggttggcttcattgcccagaaccgacctaagggcgactctgaggactggcttattctgacccccggggtgggtcttgacgacaagggagacgctctcggacagcagtaccgaactgttgaggatgtcatgtctaccggaacggatatcataattgtcggccgaggtctgtacggccagaaccgagatcctattgaggaggccaagcgataccagaaggctggctgggaggcttaccagaagattaactgttagaggttagactatggatatgtaatttaactgtgtatatagagagcgtgcaagtatggagcgcttgttcagcttgtatgatggtcagacgacctgtctgatcgagtatgtatgatactgcacaacctgtgtatccgcatgatctgtccaatggggcatgttgttgtgtttctcgatacggagatgctgggtacagtgctaatacgttgaactacttatacttatatgaggctcgaagaaagctgacttgtgtatgacttaattaacgcggcgcgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgatgcggtgtgaaataccgcacagatgcgtaaggagaaaataccgcatcaggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggcccgacgtcgcatgccacttagtctacagattacgtgtggtgtactggtacctgtggtgtagcgacagtattgtacatactcgtactcccactctacacacccgccgccaccacttaccctcgtgagaaccccctcagaaactcacaaccgtcaccttagcagaagggtttagccgcttggagccgacagggatgtcaggcaatacagctgtcaccgaggggacaccggggtgtcaacaacagtgtcatttcggtgcttgtggagtgagtgacatcaccgagaaagttgtagtatgtaggggtttttggaatggttgtttcatgatccattggtactgctcggcaaaaatagcctgatggaatcacgtttcgttctggggttgacgggcatctcagctatctccatccacgagtgtctcagagataagacctgcatatctgttatctgttttcaaagtgtaagtcgtatagagtgccgggagggggtcaaggatgtgcatggacgtgactacagtgagagtttttggaggaagtaaagaccgagtatcgaccatccagaaaccccatatcttctggaattccacaaatggccaagactggcttcttttatccactttttgatactaaaaatgtctaatttgacctctcttccactaacaaaaacagtctcgccgttctccaacccgcaccaccaactacaagtacagtagctataattttttggcaccactcgcttttctctttttaggcgaaacttgtctcaaacttatcatgccataggcattaatttccgggtcttgcagagctactgcactggggggggggggtgtacaacgcacgaccgagtgctatgtaatgtacacaatggccacaaacacaactgttactgatgtaccgatgactcagcacctacagtagtccacgcgtttgacttccggggctcttcgggcccaatttttttcttcgtctgcttcccaaatgccagatttatgcaaggtgcatgtgacgtcccggtccgaggattgctataacgggcgaaataaggacacaaacaactcaaaaataataccaaaatatagcttgcaacaagggcttcagattgatcccattattggtccat

SEQ ID NO: 103 - DNA, 1260 bp, Euglena anabaena UTEX 373
  CDS (1)..(1260): synthetic delta-8 desaturase (codon-optimized for Yarrowia lipolytica)
atggtcaagcgacccgctctgcctctcaccgtggacggtgtcacctacgacgtttctgcctggctcaaccaccatcccggaggtgccgacattatcgagaactaccgaggtcgggatgctaccgacgtcttcatggttatgcactccgagaacgccgtgtccaaactcagacgaatgcccatcatggaaccttcctctcccctgactccaacacctcccaagccaaactccgacgaacctcaggaggatttccgaaagctgcgagacgagctcattgctgcaggcatgttcgatgcctctcccatgtggtacgcttacaagaccctgtcgactctcggactgggtgtccttgccgtgctgttgatgacccagtggcactggtacctggttggtgctatcgtcctcggcattcactttcaacagatgggatggctctcgcacgacatttgccatcaccagctgttcaaggaccgatccatcaacaatgccattggcctgctcttcggaaacgtgcttcagggcttttctgtcacttggtggaaggaccgacacaacgctcatcactccgccaccaacgtgcagggtcacgatcccgacatcgacaacctgcctctcctggcgtggtccaaggaggacgtcgagcgagctggcccgttttctcgacggatgatcaagtaccaacagtattacttctttttcatctgtgcccttctgcgattcatctggtgctttcagtccattcatactgccacgggtctcaaggatcgaagcaatcagtactatcgaagacagtacgagaaggagtccgtcggtctggcactccactggggtctcaaggccttgttctactatttctacatgccctcgtttctcaccggactcatggtgttctttgtctccgagctgcttggtggcttcggaattgccatcgttgtcttcatgaaccactaccctctggagaagattcaggactccgtgtgggatggtcatggcttctgtgctggacagattcacgagaccatgaacgttcagcgaggcctcgtcacagactggtttttcggtggcctcaactaccagatcgaacatcacctgtggcctactcttcccagacacaacctcaccgctgcctccatcaaagtggagcagctgtgcaagaagcacaacctgccctaccgatctcctcccatgctcgaaggtgtcggcattcttatctcctacctgggcaccttcgctcgaatggttgccaaggcagacaaggcc

SEQ ID NO: 104 - protein, 420 aa, Euglena anabaena UTEX 373
MVKRPALPLTVDGVTYDVSAWLNHHPGGADIIENYRGRDATDVFMVMHSENAVSKLRRMPIMEPSSPLTPTPPKPNSDEPQEDFRKLRDELIAAGMFDASPMWYAYKTLSTLGLGVLAVLLMTQWHWYLVGAIVLGIHFQQMGWLSHDICHHQLFKDRSINNAIGLLFGNVLQGFSVTWWKDRHNAHHSATNVQGHDPDIDNLPLLAWSKEDVERAGPFSRRMIKYQQYYFFFICALLRFIWCFQSIHTATGLKDRSNQYYRRQYEKESVGLALHWGLKALFYYFYMPSFLTGLMVFFVSELLGGFGIAIVVFMNHYPLEKIQDSVWDGHGFCAGQIHETMNVQRGLVTDWFFGGLNYQIEHHLWPTLPRHNLTAASIKVEQLCKKHNLPYRSPPMLEGVGILISYLGTFARMVAKADKA

SEQ ID NO: 105 - DNA, 1350 bp, Euglena gracilis
  CDS (1)..(1350): EgD5M (i.e., EgD5R*-34g158g) mutant delta-5 desaturase
atggccctgtctctcactaccgaacagctcctggagcgacctgatctcgtcgctatcgatggtatcctgtacgacctcgagggcctggccaaggtgcatggtggtggagacctcattctggcctctggagcctccgacgcctctcccctcttctactctatgcatccctacgtcaagcccgagaactccaagctcctgcagcaattcgtccgagggaagcatgaccgcacctcgaaggacattgtctacacgtatgattctcccttcgcacaagacgttaagcggacaatgcgcgaggtgatgaaagggaggaactggtacgcaacccctggcttctggctgcgcaccgttgggatcatcgccgtgacggccttttgcgagtggcactgggctaccacggggatggtgctgtggggcctgttgactggattcatgcacatgcagatcggcttatccatccagcatgatgcgggtcacggggccatcagcaagaagccttgggtcaacgccctcttcgcctacggcattgacgtcatcggatcgtcccggtggatttggctgcagtcgcacatcatgcggcaccacacctacaccaaccagcacggcctcgacctggatgcggagtcggcagagccgttcctggtgttccacaactaccccgccgcaaacaccgcccgaaagtggttccaccgcttccaggcttggtacatgtaccttgtgctgggggcatacggggtatcgctggtgtacaacccgctctacattttccggatgcagcacaatgacaccatcccagagtctgtcacggccatgcgggaaaatggctttctgcggcgctaccgcacacttgcattcgtgatgcgagctttcttcatcttccggaccgcattcttgccctggtacctcactgggacctcattgctgatcaccattcctctggtgcccaccgcaactggtgccttcttgacgttcttcttcattttgtcccacaattttgatggctccgaacggatccccgacaagaactgcaaggttaagcgatctgagaaggacgttgaggctgaccaaattgactggtatcgggcgcaggtggagacgtcctccacatacggtggccccatcgccatgttcttcactggcggtctcaatttccagatcgagcaccacctctttccccggatgtcgtcttggcactaccccttcgtccagcaggcggtccgggagtgttgcgaacgacatggagtgcgatatgttttctaccctaccatcgtcggcaacatcatctccaccctgaagtacatgcataaggtgggtgtcgtccactgcgtgaaggacgcacaggattcctaa

SEQ ID NO: 106 - protein, 449 aa, Euglena gracilis
MALSLTTEQLLERPDLVAIDGILYDLEGLAKVHGGGDLILASGASDASPLFYSMHPYVKPENSKLLQQFVRGKHDRTSKDIVYTYDSPFAQDVKRTMREVMKGRNWYATPGFWLRTVGIIAVTAFCEWHWATTGMVLWGLLTGFMHMQIGLSIQHDAGHGAISKKPWVNALFAYGIDVIGSSRWIWLQSHIMRHHTYTNQHGLDLDAESAEPFLVFHNYPAANTARKWFHRFQAWYMYLVLGAYGVSLVYNPLYIFRMQHNDTIPESVTAMRENGFLRRYRTLAFVMRAFFIFRTAFLPWYLTGTSLLITIPLVPTATGAFLTFFFILSHNFDGSERIPDKNCKVKRSEKDVEADQIDWYRAQVETSSTYGGPIAMFFTGGLNFQIEHHLFPRMSSWHYPFVQQAVRECCERHGVRYVFYPTIVGNIISTLKYMHKVGVVHCVKDAQDS

SEQ ID NO: 107 - DNA, 1350 bp, Euglena gracilis
  CDS (1)..(1350): EgD5M1 (i.e., EgD5R*-34g158g347s) mutant delta-5 desaturase
atggccctgtctctcactaccgaacagctcctggagcgacctgatctcgtcgctatcgatggtatcctgtacgacctcgagggcctggccaaggtgcatggtggtggagacctcattctggcctctggagcctccgacgcctctcccctcttctactctatgcatccctacgtcaagcccgagaactccaagctcctgcagcaattcgtccgagggaagcatgaccgcacctcgaaggacattgtctacacgtatgattctcccttcgcacaagacgttaagcggacaatgcgcgaggtgatgaaagggaggaactggtacgcaacccctggcttctggctgcgcaccgttgggatcatcgccgtgacggccttttgcgagtggcactgggctaccacggggatggtgctgtggggcctgttgactggattcatgcacatgcagatcggcttatccatccagcatgatgcgggtcacggggccatcagcaagaagccttgggtcaacgccctcttcgcctacggcattgacgtcatcggatcgtcccggtggatttggctgcagtcgcacatcatgcggcaccacacctacaccaaccagcacggcctcgacctggatgcggagtcggcagagccgttcctggtgttccacaactaccccgccgcaaacaccgcccgaaagtggttccaccgcttccaggcttggtacatgtaccttgtgctgggggcatacggggtatcgctggtgtacaacccgctctacattttccggatgcagcacaatgacaccatcccagagtctgtcacggccatgcgggaaaatggctttctgcggcgctaccgcacacttgcattcgtgatgcgagctttcttcatcttccggaccgcattcttgccctggtacctcactgggacctcattgctgatcaccattcctctggtgcccaccgcaactggtgccttcttgacgttcttcttcattttgtcccacaattttgatggctccgaacggatccccgacaagaactgcaaggttaagagctctgagaaggacgttgaggctgaccaaattgactggtatcgggcgcaggtggagacgtcctccacatacggtggccccatcgccatgttcttcactggcggtctcaatttccagatcgagcaccacctctttccccggatgtcgtcttggcactaccccttcgtccagcaggcggtccgggagtgttgcgaacgacatggagtgcgatatgttttctaccctaccatcgtcggcaacatcatctccaccctgaagtacatgcataaggtgggtgtcgtccactgcgtgaaggacgcacaggattcctaa

SEQ ID NO: 108 - protein, 449 aa, Euglena gracilis
MALSLTTEQLLERPDLVAIDGILYDLEGLAKVHGGGDLILASGASDASPLFYSMHPYVKPENSKLLQQFVRGKHDRTSKDIVYTYDSPFAQDVKRTMREVMKGRNWYATPGFWLRTVGIIAVTAFCEWHWATTGMVLWGLLTGFMHMQIGLSIQHDAGHGAISKKPWVNALFAYGIDVIGSSRWIWLQSHIMRHHTYTNQHGLDLDAESAEPFLVFHNYPAANTARKWFHRFQAWYMYLVLGAYGVSLVYNPLYIFRMQHNDTIPESVTAMRENGFLRRYRTLAFVMRAFFIFRTAFLPWYLTGTSLLITIPLVPTATGAFLTFFFILSHNFDGSERIPDKNCKVKSSEKDVEADQIDWYRAQVETSSTYGGPIAMFFTGGLNFQIEHHLFPRMSSWHYPFVQQAVRECCERHGVRYVFYPTIVGNIISTLKYMHKVGVVHCVKDAQDS

SEQ ID NO: 109 - DNA, 1350 bp, Euglena gracilis
  CDS (1)..(1350): EgD5S-36s157g mutant delta-5 desaturase
atggctctctcccttactaccgagcagctgctcgagcgacccgacctggttgccatcgacggcattctctacgatctggaaggtcttgccaaggtccatcccggatccgacttgatcctcgcttctggtgcctccgatgcttctcctctgttctactccatgcacccttacgtcaagcccgagaactcgaagctgcttcaacagttcgtgcgaggcaagcacgaccgaacctccaaggacattgtctacacctacgactctccctttgcacaggacgtcaagcgaactatgcgagaggtcatgaaaggtcggaactggtatgccacacctggattctggctgcgaaccgttggcatcattgctgtcaccgccttttgcgagtggcactgggctactaccggaatggtgctgtggggtctcttgactggattcatgcacatgcagatcggcctgtccattcagcacgatggttctcatggtgccatcagcaaaaagccctgggtcaacgctctctttgcctacggcatcgacgtcattggatcgtccagatggatctggctgcagtctcacatcatgcgacatcacacctacaccaatcagcatggtctcgacctggatgccgagtccgcagaaccattccttgtgttccacaactaccctgctgccaacactgctcgaaagtggtttcaccgattccaggcctggtacatgtacctcgtgcttggagcctacggcgtttcgctggtgtacaaccctctctacatcttccgaatgcagcacaacgacaccattcccgagtctgtcacagccatgcgagagaacggctttctgcgacggtaccgaacccttgcattcgttatgcgagctttcttcatctttcgaaccgccttcttgccctggtatctcactggaacctccctgctcatcaccattcctctggtgcccactgctaccggtgccttcctcaccttctttttcatcttgtctcacaacttcgatggctcggagcgaatccccgacaagaactgcaaggtcaagagctccgagaaggacgttgaagccgatcagatcgactggtacagagctcaggtggagacctcttccacctacggtggacccattgccatgttctttactggcggtctcaacttccagatcgagcatcacctctttcctcgaatgtcgtcttggcactatcccttcgtgcagcaagctgtccgagagtgttgcgaacgacacggagttcggtacgtcttctaccctaccattgtgggcaacatcatttccaccctcaagtacatgcacaaagtcggtgtggttcactgtgtcaaggacgctcaggattcctaa

SEQ ID NO: 110 - protein, 449 aa, Euglena gracilis
MALSLTTEQLLERPDLVAIDGILYDLEGLAKVHPGSDLILASGASDASPLFYSMHPYVKPENSKLLQQFVRGKHDRTSKDIVYTYDSPFAQDVKRTMREVMKGRNWYATPGFWLRTVGIIAVTAFCEWHWATTGMVLWGLLTGFMHMQIGLSIQHDGSHGAISKKPWVNALFAYGIDVIGSSRWIWLQSHIMRHHTYTNQHGLDLDAESAEPFLVFHNYPAANTARKWFHRFQAWYMYLVLGAYGVSLVYNPLYIFRMQHNDTIPESVTAMRENGFLRRYRTLAFVMRAFFIFRTAFLPWYLTGTSLLITIPLVPTATGAFLTFFFILSHNFDGSERIPDKNCKVKSSEKDVEADQIDWYRAQVETSSTYGGPIAMFFTGGLNFQIEHHLFPRMSSWHYPFVQQAVRECCERHGVRYVFYPTIVGNIISTLKYMHKVGVVHCVKDAQDS

SEQ ID NO: 111 - DNA, 1365 bp, Euglena anabaena
  CDS (1)..(1365): EaD5S-35a158g mutant delta-5 desaturase
atggccaccatctccctgactaccgagcagctcctggaacaccccgagctcgttgccatcgacggagtcctgtacgatctcttcggtctggccaaggtccatgccggaggcaacctcatcgaagctgccggtgcatccgacggaaccgctctgttctactccatgcatcctggagtcaagccagagaactcgaagcttctgcagcaatttgcccgaggcaagcacgaacgaagctccaaggatcccgtgtacaccttcgactctccctttgctcaggacgtcaagcagtccgttcgagaggtcatgaagggtcgaaactggtacgccactcctggcttctggctgagaaccgcactcatcatcgcttgtactgccattggcgagtggtactggatcacaaccggagcagtgatgtggggtatctttactggatacttccactcgcagattggcttggccattcaacacgatggttctcacggagccatcagcaaaaagccctgggtcaacgcctttttcgcttatggcatcgacgccattggttcctctcgttggatctggctgcagtcccacattatgcgacatcacacttacaccaaccagcatggcctcgacctggatgctgcctcggcagagccgttcatcttgttccactcctatcctgctaccaacgcctctcgaaagtggtaccaccgatttcaggcgtggtacatgtacatcgttctgggaatgtatggtgtctcgatggtgtacaatcccatgtacctcttcacaatgcagcacaacgacaccattcccgaggccacttctctcagaccaggcagctttttcaatcggcagcgagctttcgccgtttcccttcgactgctcttcatcttccgaaacgcctttcttccctggtacattgctggtgcctctcctctgctcaccattcttctggtgcccacggtcacaggcatcttcctcacctttgtgttcgttctgtcccataacttcgagggagccgaacggaccccagagaagaactgcaaggccaaacgagctaaggaaggcaaggaggtcagagacgtggaagaggatcgagtcgactggtaccgagcacaggccgagactgctgccacctacggtggcagcgtgggaatgatgcttacaggcggtctcaacctgcagatcgagcatcacttgtttccccgaatgtcctcttggcactatcccttcattcaagacaccgttcgggagtgttgcaagcgacatggcgtccgttacacatactatcctaccattctcgagaacatcatgtccactcttcgatacatgcagaaggtgggtgttgctcacaccattcaggatgcccaggagttctaa

SEQ ID NO: 112 - protein, 454 aa, Euglena anabaena
MATISLTTEQLLEHPELVAIDGVLYDLFGLAKVHAGGNLIEAAGASDGTALFYSMHPGVKPENSKLLQQFARGKHERSSKDPVYTFDSPFAQDVKQSVREVMKGRNWYATPGFWLRTALIIACTAIGEWYWITTGAVMWGIFTGYFHSQIGLAIQHDGSHGAISKKPWVNAFFAYGIDAIGSSRWIWLQSHIMRHHTYTNQHGLDLDAASAEPFILFHSYPATNASRKWYHRFQAWYMYIVLGMYGVSMVYNPMYLFTMQHNDTIPEATSLRPGSFFNRQRAFAVSLRLLFIFRNAFLPWYIAGASPLLTILLVPTVTGIFLTFVFVLSHNFEGAERTPEKNCKAKRAKEGKEVRDVEEDRVDWYRAQAETAATYGGSVGMMLTGGLNLQIEHHLFPRMSSWHYPFIQDTVRECCKRHGVRYTYYPTILENIMSTLRYMQKVGVAHTIQDAQEF

SEQ ID NO: 113 - DNA, 13926 bp, Artificial Sequence
  Plasmid pZR5AU-555
cgatccctaactgtatactagcattctgaattaatatcttcctctttgattgttccttaggcatatcagcggggatcccgtcaacagttttatatatcgtagttacaaccatcaacactttttggtaagtgtaccattctatactccaactggtctgcaactgtacaagtagacatgttaatggtagttaataacatctacagcagaacctatggtaaagacattgcatttttacaggaagtatcgtcctacacgttgataaatccaaagatgcggaacttcttccacttttatcatcatcccctactcgtacactcgtactctttgttcgatcgcgattcatttctataaataatcttgtatgtacatgcggccgcttagaactcctgggcatcctgaatggtgtgagcaacacccaccttctgcatgtatcgaagagtggacatgatgttctcgagaatggtaggatagtatgtgtaacggacgccatgtcgcttgcaacactcccgaacggtgtcttgaatgaagggatagtgccaagaggacattcggggaaacaagtgatgctcgatctgcaggttgagaccgcctgtaagcatcattcccacgctgccaccgtaggtggcagcagtctcggcctgtgctcggtaccagtcgactcgatcctcttccacgtctctgacctccttgccttccttagctcgtttggccttgcagttcttctctggggtccgttcggctccctcgaagttatgggacagaacgaacacaaaggtgaggaagatgcctgtgaccgtgggcaccagaagaatggtgagcagaggagaggcaccagcaatgtaccagggaagaaaggcgtttcggaagatgaagagcagtcgaagggaaacggcgaaagctcgctgccgattgaaaaagctgcctggtctgagagaagtggcctcgggaatggtgtcgttgtgctgcattgtgaagaggtacatgggattgtacaccatcgagacaccatacattcccagaacgatgtacatgtaccacgcctgaaatcggtggtaccactttcgagaggcgttggtagcaggataggagtggaacaagatgaacggctctgccgaggcagcatccaggtcgaggccatgctggttggtgtaagtgtgatgtcgcataatgtgggactgcagccagatccaacgagaggaaccaatggcgtcgatgccataagcgaaaaaggcgttgacccagggctttttgctgatggctccgtgagaaccatcgtgttgaatggccaagccaatctgcgagtggaagtatccagtaaagataccccacatcactgctccggttgtgatccagtaccactcgccaatggcagtacaagcgatgatgagtgcggttctcagccagaagccaggagtggcgtaccagtttcgacccttcatgacctctcgaacggactgcttgacgtcctgagcaaagggagagtcgaaggtgtacacgggatccttggagcttcgttcgtgcttgcctcgggcaaattgctgcagaagcttcgagttctctggcttgactccaggatgcatggagtagaacagagcggttccgtcggatgcaccggcagcttcgatgaggttgcctccggcatggaccttggccagaccgaagagatcgtacaggactccgtcgatggcaacgagctcggggtgttccaggagctgctcggtagtcagggagatggtggccatggttgtgaattagggtggtgagaatggttggttgtagggaagaatcaaaggccggtctcgggatccgtgggtatatatatatatatatatatatacgatccttcgttacctccctgttctcaaaactgtggtttttcgtttttcgttttttgctttttttgatttttttagggccaactaagcttccagatttcgctaatcacctttgtactaattacaagaaaggaagaagctgattagagttgggctttttatgcaactgtgctactccttatctctgatatgaaagtgtagacccaatcacatcatgtcatttagagttggtaatactgggaggatagataaggcacgaaaacgagccatagcagacatgctgggtgtagccaagcagaagaaagtagatgggagccaattgacgagcgagggagctacgccaatccgacatacgacacgctgagatcgtcttggccggggggtacctacagatgtccaagggtaagtgcttgactgtaattgtatgtctgaggacaaatatgtagtcagccgtataaagtcataccaggcaccagtgccatcatcgaaccactaactctctatgatacatgcctccggtattattgtaccatgcgtcgctttgttacatacgtatcttgcctttttctctcagaaactccagactttggctattggtcgagataagcccggaccatagtgagtctttcacactctgtttaaacaagctaccaccacactcgttgggtgcagtcgacgagtatctgtctgactcgtcattgccgcctttggagtacgactccaactatgagtgtgcttggatcactttgacgatacattcttcgttggaggctgtgggtctgacagctgcgttttcggcgcggttggccgacaacaatatcagctgcaacgtcattgctggctttcatcatgatcacatttttgtcggcaaaggcgacgcccagagagccattgacgttctttctaatttggaccgatagccgtatagtccagtctatctataagttcaactaactcgtaactattaccataacatatacttcactgccccagataaggttccgataaaaagttctgcagactaaatttatttcagtctcctcttcaccaccaaaatgccctcctacgaagctcgagctaacgtccacaagtccgcctttgccgctcgagtgctcaagctcgtggcagccaagaaaaccaacctgtgtgcttctctggatgttaccaccaccaaggagctcattgagcttgccgataaggtcggaccttatgtgtgcatgatcaaaacccatatcgacatcattgacgacttcacctacgccggcactgtgctccccctcaaggaacttgctcttaagcacggtttcttcctgttcgaggacagaaagttcgcagatattggcaacactgtcaagcaccagtaccggtgtcaccgaatcgccgagtggtccgatatcaccaacgcccacggtgtacccggaaccggaatcattgctggcctgcgagctggtgccgaggaaactgtctctgaacagaagaaggaggacgtctctgactacgagaactcccagtacaaggagttcctagtcccctctcccaacgagaagctggccagaggtctgctcatgctggccgagctgtcttgcaagggctctctggccactggcgagtactccaagcagaccattgagcttgcccgatccgaccccgagtttgtggttggcttcattgcccagaaccgacctaagggcgactctgaggactggcttattctgacccccggggtgggtcttgacgacaagggagacgctctcggacagcagtaccgaactgttgaggatgtcatgtctaccggaacggatatcataattgtcggccgaggtctgtacggccagaaccgagatcctattgaggaggccaagcgataccagaaggctggctgggaggcttaccagaagattaactgttagaggttagactatggatatgtaatttaactgtgtatatagagagcgtgcaagtatggagcgcttgttcagcttgtatgatggtcagacgacctgtctgatcgagtatgtatgatactgcacaacctgtgtatccgcatgatctgtccaatggggcatgttgttgtgtttctcgatacggagatgctgggtacagtgctaatacgttgaactacttatacttatatgaggctcgaagaaagctgacttgtgtatgacttattctcaactacatccccagtcacaataccaccactgcactaccactacaccaaaaccatgatcaaaccaccgatggacttcctggaggcagaagaacttgttatggaaaagctcaagagagagaattcaggagagaccgggttggcggcgtatttgtgtcccaaaaaacagccccaattgccccggagaagacggccaggccgcctagatgacaaattcaacaactcacagctgactttctgccattgccactaggggggggcctttttatatggccaagccaagctctccacgtcggttgggctgcacccaacaataaatgggtagggttgcaccaacaaagggatgggatggggggtagaagatacgaggataacggggctcaatggcacaaataagaacgaatactgccattaagactcgtgatccagcgactgacaccattgcatcatctaagggcctcaaaactacctcggaactgctgcgctgatctggacaccacagaggttccgagcactttaggttgcaccaaatgtcccaccaggtgcaggcagaaaacgctggaacagcgtgtacagtttgtcttaacaaaaagtgagggcgctgaggtcgagcagggtggtgtgacttgttatagcctttagagctgcgaaagcgcgtatggatttggctcatcaggccagattgagggtctgtggacacatgtcatgttagtgtacttcaatcgccccctggatatagccccgacaataggccgtggcctcatttttttgccttccgcacatttccattgctcggtacccacaccttgcttctcctgcacttgccaaccttaatactggtttacattgaccaacatcttacaagcggggggcttgtctagggtatatataaacagtggctctcccaatcggttgccagtctcttttttcctttctttccccacagattcgaaatctaaactacacatcacacaatgcctgttactgacgtccttaagcgaaagtccggtgtcatcgtcggcgacgatgtccgagccgtgagtatccacgacaagatcagtgtcgagacgacgcgttttgtgtaatgacacaatccgaaagtcgctagcaacacacactctctacacaaactaacccagctctccatggctctctcccttactaccgagcagctgctcgagcgacccgacctggttgccatcgacggcattctctacgatctggaaggtcttgccaaggtccatcccggatccgacttgatcctcgcttctggtgcctccgatgcttctcctctgttctactccatgcacccttacgtcaagcccgagaactcgaagctgcttcaacagttcgtgcgaggcaagcacgaccgaacctccaaggacattgtctacacctacgactctccctttgcacaggacgtcaagcgaactatgcgagaggtcatgaaaggtcggaactggtatgccacacctggattctggctgcgaaccgttggcatcattgctgtcaccgccttttgcgagtggcactgggctactaccggaatggtgctgtggggtctcttgactggattcatgcacatgcagatcggcctgtccattcagcacgatggttctcatggtgccatcagcaaaaagccctgggtcaacgctctctttgcctacggcatcgacgtcattggatcgtccagatggatctggctgcagtctcacatcatgcgacatcacacctacaccaatcagcatggtctcgacctggatgccgagtccgcagaaccattccttgtgttccacaactaccctgctgccaacactgctcgaaagtggtttcaccgattccaggcctggtacatgtacctcgtgcttggagcctacggcgtttcgctggtgtacaaccctctctacatcttccgaatgcagcacaacgacaccattcccgagtctgtcacagccatgcgagagaacggctttctgcgacggtaccgaacccttgcattcgttatgcgagctttcttcatctttcgaaccgccttcttgccctggtatctcactggaacctccctgctcatcaccattcctctggtgcccactgctaccggtgccttcctcaccttctttttcatcttgtctcacaacttcgatggctcggagcgaatccccgacaagaactgcaaggtcaagagctccgagaaggacgttgaagccgatcagatcgactggtacagagctcaggtggagacctcttccacctacggtggacccattgccatgttctttactggcggtctcaacttccagatcgagcatcacctctttcctcgaatgtcgtcttggcactatcccttcgtgcagcaagctgtccgagagtgttgcgaacgacacggagttcggtacgtcttctaccctaccattgtgggcaacatcatttccaccctcaagtacatgcacaaagtcggtgtggttcactgtgtcaaggacgctcaggattcctaagcggccgcaagtgtggatggggaagtgagtgcccggttctgtgtgcacaattggcaatccaagatggatggattcaacacagggatatagcgagctacgtggtggtgcgaggatatagcaacggatatttatgtttgacacttgagaatgtacgatacaagcactgtccaagtacaatactaaacatactgtacatactcatactcgtacccgggcaacggtttcacttgagtgcagtggctagtgctcttactcgtacagtgtgcaatactgcgtatcatagtctttgatgtatatcgtattcattcatgttagttgcgtacgacagacggacaatgacgagccaggttcgcccaactgacggaatctcctatagtcttctcatcaagcgcataaatatagtatataaagaattacatggtgggccacagcttggcgatagtatgacggtctgggctccagatcacacccatgagggatgccgtgcgagtagatgtagaggtggtgcttccaggttgtccccaacaacaatcgctactggaaaataccgtgaaagtacgtacacccaactctgtgactcgcgttgactttcatctttcaatttggtcgtgtcttacggtgcatgtgctgtattggacatgaagaaggggttggcaagctgaaccatgcctgaggtgctggagtctgatactgtctagcagagggcgatcaaaagatcaccatccacacgtttgtttccatattcaatctccaatttccaacatctccttggctaatagccactttgagagatatttggtatcgcgtattcacttgtctcatatcccgtgtttctgtttcaccaaggcttggacgatattatcgcgagaaaaaccgtattgaggtatttattagagtcgagagaggaggaacaggtattcggaagatggaaaagctgtacagagcgagaaacgatcccatgtcgacgctcctgatggcttatactgagacatggaatcaggatcttgcccttcttcacagctctacttgcagctacagaattgctttttctcgtatccgatcataattccgctgctatgataggcagccaccgatacaatataggagagagtataggtattgactctatagacactgtatgatgctgacaaagctgactgagggattcgactcagcttcgccgttgcttgatctccaattaattatcgtaggcgcgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgatgcggtgtgaaataccgcacagatgcgtaaggagaaaataccgcatcaggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggcccgacgtcgcatgcattaccaacgttggcgcgccacaacgtcagaaactctcttccatccgataagccgtgtctaactatacgaccctcaaacaaggtcagccagaccaacttttagcactcgcaaaacacacacccaaacccaggccgcgacgcagccggagcccgtctacttatactgtttcgccgcagacgccaagtgacacaaaaagcgcacaaaccctcccccccagtggcggcgcacatccacaacaaacgacccataaacggcactcccacacggaaacaaaacgtttgtcgggttactcctcacgccaagacacactcacacacacaacctcccacctttcatcaccactcaactacgggtacagtagtggtagaaaacacagagtccagagtccacacagacaccgcacagagtctgtcacacaagcaccatgccaacaagcagaccgttcatttcgctgctgtttggaagcttctccacgtcgtatcaacgcaacaccaccacacagacctccgcatcgacagccaccgtcaccaccggccccacgtcgcagatgtacaagatgctcgacaaccactcgatacctgagcagccccagcagccgaccctgactcagacacagccagcggtgcagacggcgcagacggcgcagacggcgcagcaggcaagtgggactgcggacctcagcgaatcgccacacgacaagctgtggattggaggccgatcaaacgacggacgggaaaagttctaccggctggaaccggccaagcgaagggcatccttcgatcgcatttctctggatcaggtgtctatttgatgaggcgccaaacagtggccagaccaagtctggtatctcaacccctcaaaattgataaccaagtttctggtggagttcaaaccaaggggagctacggagccgttcacaaggtgtccacagaggttcaaagcacattgcaccaagaccgccatcatccttaattaaaaggcgttgaaacagaatgagccagacagcaaggacaaggtggccaacagcaaggagtccaaaaagccctctattgacgagatccacgatgttattgctcatgaggtttccgagctcgatgctgggaagaagaagtgatttgtatataagaaataaatgagatatagtaaaggagtgcaagagaatggcaaggtggtcaaattctatattacttgcagtcactggttcctcgttgacatgaatgaagttaccgttggcatagctgatttaatatataactgtccaactaactctcacctagatataacccatgtgtgtgtttccaatcatcaatgcggccgcttaggaatcctgtgcgtccttcacgcagtggacgacacccaccttatgcatgtacttcagggtggagatgatgttgccgacgatggtagggtagaaaacatatcgcactccatgtcgttcgcaacactcccggaccgcctgctggacgaaggggtagtgccaagacgacatccggggaaagaggtggtgctcgatctggaaattgagaccgccagtgaagaacatggcgatggggccaccgtatgtggaggacgtctccacctgcgcccgataccagtcaatttggtcagcctcaacgtccttctcagatcgcttaaccttgcagttcttgtcggggatccgttcggagccatcaaaattgtgggacaaaatgaagaagaacgtcaagaaggcaccagttgcggtgggcaccagaggaatggtgatcagcaatgaggtcccagtgaggtaccagggcaagaatgcggtccggaagatgaagaaagctcgcatcacgaatgcaagtgtgcggtagcgccgcagaaagccattttcccgcatggccgtgacagactctgggatggtgtcattgtgctgcatccggaaaatgtagagcgggttgtacaccagcgataccccgtatgcccccagcacaaggtacatgtaccaagcctggaagcggtggaaccactttcgggcggtgtttgcggcggggtagttgtggaacaccaggaacggctctgccgactccgcatccaggtcgaggccgtgctggttggtgtaggtgtggtgccgcatgatgtgcgactgcagccaaatccaccgggacgatccgatgacgtcaatgccgtaggcgaagagggcgttgacccaaggcttcttgctgatggccccgtgacccgcatcatgctggatggataagccgatctgcatgtgcatgaatccagtcaacaggccccacagcaccatccccgtggtagcccagtgccactcgcaaaaggccgtcacggcgatgatcccaacggtgcgcagccagaagccaggggttgcgtaccagttcctccctttcatcacctcgcgcattgtccgcttaacgtcttgtgcgaagggagaatcatacgtgtagacaatgtccttcgaggtgcggtcatgcttccctcggacgaattgctgcaggagcttggagttctcgggcttgacgtagggatgcatagagtagaagaggggagaggcgtcggaggctccagaggccagaatgaggtctccaccaccatgcaccttggccaggccctcgaggtcgtacaggataccatcgatagcgacgagatcaggtcgctccaggagctgttcggtagtgagagacagggccatggccattgctgtagatatgtcttgtgtgtaagggggttggggtggttgtttgtgttcttgacttttgtgttagcaagggaagacgggcaaaaaagtgagtgtggttgggagggagagacgagccttatatataatgcttgtttgtgtttgtgcaagtggacgccgaaacgggcaggagccaaactaaacaaggcagacaatgcgagcttaattggattgcctgatgggcaggggttagggctcgatcaatgggggtgcgaagtgacaaaattgggaattaggttcgcaagcaaggctgacaagactttggcccaaacatttgtacgcggtggacaacaggagccacccatcgtctgtcacgggctagccggtcgtgcgtcctgtcaggctccacctaggctccatgccactccatacaatcccactagtgtaccgctaggccgcttttagctcccatctaagacccccccaaaacctccactgtacagtgcactgtactgtgtggcgatcaagggcaagggaaaaaaggcgcaaacatgcacgcatggaatgacgtaggtaaggcgttactagactgaaaagtggcacatttcggcgtgccaaagggtcctaggtgcgtttcgcgagctgggcgccaggccaagccgctccaaaacgcctctccgactccctccagcggcctccatatccccatccctctccacagcaatgttgttaagccttgcaaacgaaaaaatagaaaggctaataagcttccaatattgtggtgtacgctgcataacgcaacaatgagcgccaaacaacacacacacacagcacacagcagcattaaccat

SEQ ID NO: 114 - DNA, 13926 bp, Artificial Sequence
  Plasmid pZR5AU-555m
cgatccctaactgtatactagcattctgaattaatatcttcctctttgattgttccttaggcatatcagcggggatcccgtcaacagttttatatatcgtagttacaaccatcaacactttttggtaagtgtaccattctatactccaactggtctgcaactgtacaagtagacatgttaatggtagttaataacatctacagcagaacctatggtaaagacattgcatttttacaggaagtatcgtcctacacgttgataaatccaaagatgcggaacttcttccacttttatcatcatcccctactcgtacactcgtactctttgttcgatcgcgattcatttctataaataatcttgtatgtacatgcggccgcttagaactcctgggcatcctgaatggtgtgagcaacacccaccttctgcatgtatcgaagagtggacatgatgttctcgagaatggtaggatagtatgtgtaacggacgccatgtcgcttgcaacactcccgaacggtgtcttgaatgaagggatagtgccaagaggacattcggggaaacaagtgatgctcgatctgcaggttgagaccgcctgtaagcatcattcccacgctgccaccgtaggtggcagcagtctcggcctgtgctcggtaccagtcgactcgatcctcttccacgtctctgacctccttgccttccttagctcgtttggccttgcagttcttctctggggtccgttcggctccctcgaagttatgggacagaacgaacacaaaggtgaggaagatgcctgtgaccgtgggcaccagaagaatggtgagcagaggagaggcaccagcaatgtaccagggaagaaaggcgtttcggaagatgaagagcagtcgaagggaaacggcgaaagctcgctgccgattgaaaaagctgcctggtctgagagaagtggcctcgggaatggtgtcgttgtgctgcattgtgaagaggtacatgggattgtacaccatcgagacaccatacattcccagaacgatgtacatgtaccacgcctgaaatcggtggtaccactttcgagaggcgttggtagcaggataggagtggaacaagatgaacggctctgccgaggcagcatccaggtcgaggccatgctggttggtgtaagtgtgatgtcgcataatgtgggactgcagccagatccaacgagaggaaccaatggcgtcgatgccataagcgaaaaaggcgttgacccagggctttttgctgatggctccgtgagaaccatcgtgttgaatggccaagccaatctgcgagtggaagtatccagtaaagataccccacatcactgctccggttgtgatccagtaccactcgccaatggcagtacaagcgatgatgagtgcggttctcagccagaagccaggagtggcgtaccagtttcgacccttcatgacctctcgaacggactgcttgacgtcctgagcaaagggagagtcgaaggtgtacacgggatccttggagcttcgttcgtgcttgcctcgggcaaattgctgcagaagcttcgagttctctggcttgactccaggatgcatggagtagaacagagcggttccgtcggatgcaccggcagcttcgatgaggttgcctccggcatggaccttggccagaccgaagagatcgtacaggactccgtcgatggcaacgagctcggggtgttccaggagctgctcggtagtcagggagatggtggccatggttgtgaattagggtggtgagaatggttggttgtagggaagaatcaaaggccggtctcgggatccgtgggtatatatatatatatatatatatacgatccttcgttacctccctgttctcaaaactgtggtttttcgtttttcgttttttgctttttttgatttttttagggccaactaagcttccagatttcgctaatcacctttgtactaattacaagaaaggaagaagctgattagagttgggctttttatgcaactgtgctactccttatctctgatatgaaagtgtagacccaatcacatcatgtcatttagagttggtaatactgggaggatagataaggcacgaaaacgagccatagcagacatgctgggtgtagccaagcagaagaaagtagatgggagccaattgacgagcgagggagctacgccaatccgacatacgacacgctgagatcgtcttggccggggggtacctacagatgtccaagggtaagtgcttgactgtaattgtatgtctgaggacaaatatgtagtcagccgtataaagtcataccaggcaccagtgccatcatcgaaccactaactctctatgatacatgcctccggtattattgtaccatgcgtcgctttgttacatacgtatcttgcctttttctctcagaaactccagactttggctattggtcgagataagcccggaccatagtgagtctttcacactctgtttaaacaagctaccaccacactcgttgggtgcagtcgacgagtatctgtctgactcgtcattgccgcctttggagtacgactccaactatgagtgtgcttggatcactttgacgatacattcttcgttggaggctgtgggtctgacagctgcgttttcggcgcggttggccgacaacaatatcagctgcaacgtcattgctggctttcatcatgatcacatttttgtcggcaaaggcgacgcccagagagccattgacgttctttctaatttggaccgatagccgtatagtccagtctatctataagttcaactaactcgtaactattaccataacatatacttcactgccccagataaggttccgataaaaagttctgcagactaaatttatttcagtctcctcttcaccaccaaaatgccctcctacgaagctcgagctaacgtccacaagtccgcctttgccgctcgagtgctcaagctcgtggcagccaagaaaaccaacctgtgtgcttctctggatgttaccaccaccaaggagctcattgagcttgccgataaggtcggaccttatgtgtgcatgatcaaaacccatatcgacatcattgacgacttcacctacgccggcactgtgctccccctcaaggaacttgctcttaagcacggtttcttcctgttcgaggacagaaagttcgcagatattggcaacactgtcaagcaccagtaccggtgtcaccgaatcgccgagtggtccgatatcaccaacgcccacggtgtacccggaaccggaatcattgctggcctgcgagctggtgccgaggaaactgtctctgaacagaagaaggaggacgtctctgactacgagaactcccagtacaaggagttcctagtcccctctcccaacgagaagctggccagaggtctgctcatgctggccgagctgtcttgcaagggctctctggccactggcgagtactccaagcagaccattgagcttgcccgatccgaccccgagtttgtggttggcttcattgcccagaaccgacctaagggcgactctgaggactggcttattctgacccccggggtgggtcttgacgacaagggagacgctctcggacagcagtaccgaactgttgaggatgtcatgtctaccggaacggatatcataattgtcggccgaggtctgtacggccagaaccgagatcctattgaggaggccaagcgataccagaaggctggctgggaggcttaccagaagattaactgttagaggttagactatggatatgtaatttaactgtgtatatagagagcgtgcaagtatggagcgcttgttcagcttgtatgatggtcagacgacctgtctgatcgagtatgtatgatactgcacaacctgtgtatccgcatgatctgtccaatggggcatgttgttgtgtttctcgatacggagatgctgggtacagtgctaatacgttgaactacttatacttatatgaggctcgaagaaagctgacttgtgtatgacttattctcaactacatccccagtcacaataccaccactgcactaccactacaccaaaaccatgatcaaaccaccgatggacttcctggaggcagaagaacttgttatggaaaagctcaagagagagaattcaggagagaccgggttggcggcgtatttgtgtcccaaaaaacagccccaattgccccggagaagacggccaggccgcctagatgacaaattcaacaactcacagctgactttctgccattgccactaggggggggcctttttatatggccaagccaagctctccacgtcggttgggctgcacccaacaataaatgggtagggttgcaccaacaaagggatgggatggggggtagaagatacgaggataacggggctcaatggcacaaataagaacgaatactgccattaagactcgtgatccagcgactgacaccattgcatcatctaagggcctcaaaactacctcggaactgctgcgctgatctggacaccacagaggttccgagcactttaggttgcaccaaatgtcccaccaggtgcaggcagaaaacgctggaacagcgtgtacagtttgtcttaacaaaaagtgagggcgctgaggtcgagcagggtggtgtgacttgttatagcctttagagctgcgaaagcgcgtatggatttggctcatcaggccagattgagggtctgtggacacatgtcatgttagtgtacttcaatcgccccctggatatagccccgacaataggccgtggcctcatttttttgccttccgcacatttccattgctcggtacccacaccttgcttctcctgcacttgccaaccttaatactggtttacattgaccaacatcttacaagcggggggcttgtctagggtatatataaacagtggctctcccaatcggttgccagtctcttttttcctttctttccccacagattcgaaatctaaactacacatcacacaatgcctgttactgacgtccttaagcgaaagtccggtgtcatcgtcggcgacgatgtccgagccgtgagtatccacgacaagatcagtgtcgagacgacgcgttttgtgtaatgacacaatccgaaagtcgctagcaacacacactctctacacaaactaacccagctctccatggctctctcccttactaccgagcagctgctcgagcgacccgacctggttgccatcgacggcattctctacgatctggaaggtcttgccaaggtccatcccggatccgacttgatcctcgcttctggtgcctccgatgcttctcctctgttctactccatgcacccttacgtcaagcccgagaactcgaagctgcttcaacagttcgtgcgaggcaagcacgaccgaacctccaaggacattgtctacacctacgactctccctttgcacaggacgtcaagcgaactatgcgagaggtcatgaaaggtcggaactggtatgccacacctggattctggctgcgaaccgttggcatcattgctgtcaccgccttttgcgagtggcactgggctactaccggaatggtgctgtggggtctcttgactggattcatgcacatgcagatcggcctgtccattcagcacgatggttctcatggtgccatcagcaaaaagccctgggtcaacgctctctttgcctacggcatcgacgtcattggatcgtccagatggatctggctgcagtctcacatcatgcgacatcacacctacaccaatcagcatggtctcgacctggatgccgagtccgcagaaccattccttgtgttccacaactaccctgctgccaacactgctcgaaagtggtttcaccgattccaggcctggtacatgtacctcgtgcttggagcctacggcgtttcgctggtgtacaaccctctctacatcttccgaatgcagcacaacgacaccattcccgagtctgtcacagccatgcgagagaacggctttctgcgacggtaccgaacccttgcattcgttatgcgagctttcttcatctttcgaaccgccttcttgccctggtatctcactggaacctccctgctcatcaccattcctctggtgcccactgctaccggtgccttcctcaccttctttttcatcttgtctcacaacttcgatggctcggagcgaatccccgacaagaactgcaaggtcaagagctccgagaaggacgttgaagccgatcagatcgactggtacagagctcaggtggagacctcttccacctacggtggacccattgccatgttctttactggcggtctcaacttccagatcgagcatcacctctttcctcgaatgtcgtcttggcactatcccttcgtgcagcaagctgtccgagagtgttgcgaacgacacggagttcggtacgtcttctaccctaccattgtgggcaacatcatttccaccctcaagtacatgcacaaagtcggtgtggttcactgtgtcaaggacgctcaggattcctaagcggccgcaagtgtggatggggaagtgagtgcccggttctgtgtgcacaattggcaatccaagatggatggattcaacacagggatatagcgagctacgtggtggtgcgaggatatagcaacggatatttatgtttgacacttgagaatgtacgatacaagcactgtccaagtacaatactaaacatactgtacatactcatactcgtacccgggcaacggtttcacttgagtgcagtggctagtgctcttactcgtacagtgtgcaatactgcgtatcatagtctttgatgtatatcgtattcattcatgttagttgcgtacgacagacggacaatgacgagccaggttcgcccaactgacggaatctcctatagtcttctcatcaagcgcataaatatagtatataaagaattacatggtgggccacagcttggcgatagtatgacggtctgggctccagatcacacccatgagggatgccgtgcgagtagatgtagaggtggtgcttccaggttgtccccaacaacaatcgctactggaaaataccgtgaaagtacgtacacccaactctgtgactcgcgttgactttcatctttcaatttggtcgtgtcttacggtgcatgtgctgtattggacatgaagaaggggttggcaagctgaaccatgcctgaggtgctggagtctgatactgtctagcagagggcgatcaaaagatcaccatccacacgtttgtttccatattcaatctccaatttccaacatctccttggctaatagccactttgagagatatttggtatcgcgtattcacttgtctcatatcccgtgtttctgtttcaccaaggcttggacgatattatcgcgagaaaaaccgtattgaggtatttattagagtcgagagaggaggaacaggtattcggaagatggaaaagctgtacagagcgagaaacgatcccatgtcgacgctcctgatggcttatactgagacatggaatcaggatcttgcccttcttcacagctctacttgcagctacagaattgctttttctcgtatccgatcataattccgctgctatgataggcagccaccgatacaatataggagagagtataggtattgactctatagacactgtatgatgctgacaaagctgactgagggattcgactcagcttcgccgttgcttgatctccaattaattatcgtaggcgcgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgatgcggtgtgaaataccgcacagatgcgtaaggagaaaataccgcatcaggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggcccgacgtcgcatgcattaccaacgttggcgcgccacaacgtcagaaactctcttccatccgataagccgtgtctaactatacgaccctcaaacaaggtcagccagaccaacttttagcactcgcaaaacacacacccaaacccaggccgcgacgcagccggagcccgtctacttatactgtttcgccgcagacgccaagtgacacaaaaagcgcacaaaccctcccccccagtggcggcgcacatccacaacaaacgacccataaacggcactcccacacggaaacaaaacgtttgtcgggttactcctcacgccaagacacactcacacacacaacctcccacctttcatcaccactcaactacgggtacagtagtggtagaaaacacagagtccagagtccacacagacaccgcacagagtctgtcacacaagcaccatgccaacaagcagaccgttcatttcgctgctgtttggaagcttctccacgtcgtatcaacgcaacaccaccacacagacctccgcatcgacagccaccgtcaccaccggccccacgtcgcagatgtacaagatgctcgacaaccactcgatacctgagcagccccagcagccgaccctgactcagacacagccagcggtgcagacggcgcagacggcgcagacggcgcagcaggcaagtgggactgcggacctcagcgaatcgccacacgacaagctgtggattggaggccgatcaaacgacggacgggaaaagttctaccggctggaaccggccaagcgaagggcatccttcgatcgcatttctctggatcaggtgtctatttgatgaggcgccaaacagtggccagaccaagtctggtatctcaacccctcaaaattgataaccaagtttctggtggagttcaaaccaaggggagctacggagccgttcacaaggtgtccacagaggttcaaagcacattgcaccaagaccgccatcatccttaattaaaaggcgttgaaacagaatgagccagacagcaaggacaaggtggccaacagcaaggagtccaaaaagccctctattgacgagatccacgatgttattgctcatgaggtttccgagctcgatgctgggaagaagaagtgatttgtatataagaaataaatgagatatagtaaaggagtgcaagagaatggcaaggtggtcaaattctatattacttgcagtcactggttcctcgttgacatgaatgaagttaccgttggcatagctgatttaatatataactgtccaactaactctcacctagatataacccatgtgtgtgtttccaatcatcaatgcggccgcttaggaatcctgtgcgtccttcacgcagtggacgacacccaccttatgcatgtacttcagggtggagatgatgttgccgacgatggtagggtagaaaacatatcgcactccatgtcgttcgcaacactcccggaccgcctgctggacgaaggggtagtgccaagacgacatccggggaaagaggtggtgctcgatctggaaattgagaccgccagtgaagaacatggcgatggggccaccgtatgtggaggacgtctccacctgcgcccgataccagtcaatttggtcagcctcaacgtccttctcagagctcttaaccttgcagttcttgtcggggatccgttcggagccatcaaaattgtgggacaaaatgaagaagaacgtcaagaaggcaccagttgcggtgggcaccagaggaatggtgatcagcaatgaggtcccagtgaggtaccagggcaagaatgcggtccggaagatgaagaaagctcgcatcacgaatgcaagtgtgcggtagcgccgcagaaagccattttcccgcatggccgtgacagactctgggatggtgtcattgtgctgcatccggaaaatgtagagcgggttgtacaccagcgataccccgtatgcccccagcacaaggtacatgtaccaagcctggaagcggtggaaccactttcgggcggtgtttgcggcggggtagttgtggaacaccaggaacggctctgccgactccgcatccaggtcgaggccgtgctggttggtgtaggtgtggtgccgcatgatgtgcgactgcagccaaatccaccgggacgatccgatgacgtcaatgccgtaggcgaagagggcgttgacccaaggcttcttgctgatggccccgtgacccgcatcatgctggatggataagccgatctgcatgtgcatgaatccagtcaacaggccccacagcaccatccccgtggtagcccagtgccactcgcaaaaggccgtcacggcgatgatcccaacggtgcgcagccagaagccaggggttgcgtaccagttcctccctttcatcacctcgcgcattgtccgcttaacgtcttgtgcgaagggagaatcatacgtgtagacaatgtccttcgaggtgcggtcatgcttccctcggacgaattgctgcaggagcttggagttctcgggcttgacgtagggatgcatagagtagaagaggggagaggcgtcggaggctccagaggccagaatgaggtctccaccaccatgcaccttggccaggccctcgaggtcgtacaggataccatcgatagcgacgagatcaggtcgctccaggagctgttcggtagtgagagacagggccatggccattgctgtagatatgtcttgtgtgtaagggggttggggtggttgtttgtgttcttgacttttgtgttagcaagggaagacgggcaaaaaagtgagtgtggttgggagggagagacgagccttatatataatgcttgtttgtgtttgtgcaagtggacgccgaaacgggcaggagccaaactaaacaaggcagacaatgcgagcttaattggattgcctgatgggcaggggttagggctcgatcaatgggggtgcgaagtgacaaaattgggaattaggttcgcaagcaaggctgacaagactttggcccaaacatttgtacgcggtggacaacaggagccacccatcgtctgtcacgggctagccggtcgtgcgtcctgtcaggctccacctaggctccatgccactccatacaatcccactagtgtaccgctaggccgcttttagctcccatctaagacccccccaaaacctccactgtacagtgcactgtactgtgtggcgatcaagggcaagggaaaaaaggcgcaaacatgcacgcatggaatgacgtaggtaaggcgttactagactgaaaagtggcacatttcggcgtgccaaagggtcctaggtgcgtttcgcgagctgggcgccaggccaagccgctccaaaacgcctctccgactccctccagcggcctccatatccccatccctctccacagcaatgttgttaagccttgcaaacgaaaaaatagaaaggctaataagcttccaatattgtggtgtacgctgcataacgcaacaatgagcgccaaacaacacacacacacagcacacagcagcattaaccat

SEQ ID NO: 115 - DNA, 7769 bp, Artificial Sequence
  Plasmid pZUFmEgD9eS
ggccgcaagtgtggatggggaagtgagtgcccggttctgtgtgcacaattggcaatccaagatggatggattcaacacagggatatagcgagctacgtggtggtgcgaggatatagcaacggatatttatgtttgacacttgagaatgtacgatacaagcactgtccaagtacaatactaaacatactgtacatactcatactcgtacccgggcaacggtttcacttgagtgcagtggctagtgctcttactcgtacagtgtgcaatactgcgtatcatagtctttgatgtatatcgtattcattcatgttagttgcgtacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggtaccgggccccccctcgaggtcgatggtgtcgataagcttgatatcgaattcatgtcacacaaaccgatcttcgcctcaaggaaacctaattctacatccgagagactgccgagatccagtctacactgattaattttcgggccaataatttaaaaaaatcgtgttatataatattatatgtattatatatatacatcatgatgatactgacagtcatgtcccattgctaaatagacagactccatctgccgcctccaactgatgttctcaatatttaaggggtcatctcgcattgtttaataataaacagactccatctaccgcctccaaatgatgttctcaaaatatattgtatgaacttatttttattacttagtattattagacaacttacttgctttatgaaaaacacttcctatttaggaaacaatttataatggcagttcgttcatttaacaatttatgtagaataaatgttataaatgcgtatgggaaatcttaaatatggatagcataaatgatatctgcattgcctaattcgaaatcaacagcaacgaaaaaaatcccttgtacaacataaatagtcatcgagaaatatcaactatcaaagaacagctattcacacgttactattgagattattattggacgagaatcacacactcaactgtctttctctcttctagaaatacaggtacaagtatgtactattctcattgttcatacttctagtcatttcatcccacatattccttggatttctctccaatgaatgacattctatcttgcaaattcaacaattataataagatataccaaagtagcggtatagtggcaatcaaaaagcttctctggtgtgcttctcgtatttatttttattctaatgatccattaaaggtatatatttatttcttgttatataatccttttgtttattacatgggctggatacataaaggtattttgatttaattttttgcttaaattcaatcccccctcgttcagtgtcaactgtaatggtaggaaattaccatacttttgaagaagcaaaaaaaatgaaagaaaaaaaaaatcgtatttccaggttagacgttccgcagaatctagaatgcggtatgcggtacattgttcttcgaacgtaaaagttgcgctccctgagatattgtacatttttgcttttacaagtacaagtacatcgtacaactatgtactactgttgatgcatccacaacagtttgttttgtttttttttgttttttttttttctaatgattcattaccgctatgtatacctacttgtacttgtagtaagccgggttattggcgttcaattaatcatagacttatgaatctgcacggtgtgcgctgcgagttacttttagcttatgcatgctacttgggtgtaatattgggatctgttcggaaatcaacggatgctcaatcgatttcgacagtaattaattaagtcatacacaagtcagctttcttcgagcctcatataagtataagtagttcaacgtattagcactgtacccagcatctccgtatcgagaaacacaacaacatgccccattggacagatcatgcggatacacaggttgtgcagtatcatacatactcgatcagacaggtcgtctgaccatcatacaagctgaacaagcgctccatacttgcacgctctctatatacacagttaaattacatatccatagtctaacctctaacagttaatcttctggtaagcctcccagccagccttctggtatcgcttggcctcctcaataggatctcggttctggccgtacagacctcggccgacaattatgatatccgttccggtagacatgacatcctcaacagttcggtactgctgtccgagagcgtctcccttgtcgtcaagacccaccccgggggtcagaataagccagtcctcagagtcgcccttaggtcggttctgggcaatgaagccaaccacaaactcggggtcggatcgggcaagctcaatggtctgcttggagtactcgccagtggccagagagcccttgcaagacagctcggccagcatgagcagacctctggccagcttctcgttgggagaggggactaggaactccttgtactgggagttctcgtagtcagagacgtcctccttcttctgttcagagacagtttcctcggcaccagctcgcaggccagcaatgattccggttccgggtacaccgtgggcgttggtgatatcggaccactcggcgattcggtgacaccggtactggtgcttgacagtgttgccaatatctgcgaactttctgtcctcgaacaggaagaaaccgtgcttaagagcaagttccttgagggggagcacagtgccggcgtaggtgaagtcgtcaatgatgtcgatatgggttttgatcatgcacacataaggtccgaccttatcggcaagctcaatgagctccttggtggtggtaacatccagagaagcacacaggttggttttcttggctgccacgagcttgagcactcgagcggcaaaggcggacttgtggacgttagctcgagcttcgtaggagggcattttggtggtgaagaggagactgaaataaatttagtctgcagaactttttatcggaaccttatctggggcagtgaagtatatgttatggtaatagttacgagttagttgaacttatagatagactggactatacggctatcggtccaaattagaaagaacgtcaatggctctctgggcgtcgcctttgccgacaaaaatgtgatcatgatgaaagccagcaatgacgttgcagctgatattgttgtcggccaaccgcgccgaaaacgcagctgtcagacccacagcctccaacgaagaatgtatcgtcaaagtgatccaagcacactcatagttggagtcgtactccaaaggcggcaatgacgagtcagacagatactcgtcgacgtttaaacagtgtacgcagatctactatagaggaacatttaaattgccccggagaagacggccaggccgcctagatgacaaattcaacaactcacagctgactttctgccattgccactaggggggggcctttttatatggccaagccaagctctccacgtcggttgggctgcacccaacaataaatgggtagggttgcaccaacaaagggatgggatggggggtagaagatacgaggataacggggctcaatggcacaaataagaacgaatactgccattaagactcgtgatccagcgactgacaccattgcatcatctaagggcctcaaaactacctcggaactgctgcgctgatctggacaccacagaggttccgagcactttaggttgcaccaaatgtcccaccaggtgcaggcagaaaacgctggaacagcgtgtacagtttgtcttaacaaaaagtgagggcgctgaggtcgagcagggtggtgtgacttgttatagcctttagagctgcgaaagcgcgtatggatttggctcatcaggccagattgagggtctgtggacacatgtcatgttagtgtacttcaatcgccccctggatatagccccgacaataggccgtggcctcatttttttgccttccgcacatttccattgctcgatacccacaccttgcttctcctgcacttgccaaccttaatactggtttacattgaccaacatcttacaagcggggggcttgtctagggtatatataaacagtggctctcccaatcggttgccagtctcttttttcctttctttccccacagattcgaaatctaaactacacatcacagaattccgagccgtgagtatccacgacaagatcagtgtcgagacgacgcgttttgtgtaatgacacaatccgaaagtcgctagcaacacacactctctacacaaactaacccagctctggtaccatggaggtcgtgaacgaaatcgtctccattggccaggaggttcttcccaaggtcgactatgctcagctctggtctgatgcctcgcactgcgaggtgctgtacctctccatcgccttcgtcatcctgaagttcacccttggtcctctcggacccaagggtcagtctcgaatgaagtttgtgttcaccaactacaacctgctcatgtccatctactcgctgggctccttcctctctatggcctacgccatgtacaccattggtgtcatgtccgacaactgcgagaaggctttcgacaacaatgtcttccgaatcaccactcagctgttctacctcagcaagttcctcgagtacattgactccttctatctgcccctcatgggcaagcctctgacctggttgcagttctttcaccatctcggagctcctatggacatgtggctgttctacaactaccgaaacgaagccgtttggatctttgtgctgctcaacggcttcattcactggatcatgtacggctactattggacccgactgatcaagctcaagttccctatgcccaagtccctgattacttctatgcagatcattcagttcaacgttggcttctacatcgtctggaagtaccggaacattccctgctaccgacaagatggaatgagaatgtttggctggtttttcaactacttctacgttggtactgtcctgtgtctgttcctcaacttctacgtgcagacctacatcgtccgaaagcacaagggagccaaaaagattcagtgagc

SEQ ID NO: 116 - DNA, 20 bp, Artificial Sequence
  Primer pZUFm_6980_012208f
gctctggtaccatggaggtc

SEQ ID NO: 117 - DNA, 20 bp, Artificial Sequence
  Primer pZUFm_40_012208r
acagaaccgggcactcactt

SEQ ID NO: 118 - DNA, 777 bp, Euglena gracilis
  CDS (1)..(777): mutant delta-9 elongase "EgD9eS-L35F"
atggaggtcgtgaacgaaatcgtctccattggccaggaggttcttcccaaggtcgactatgctcagctctggtctgatgcctcgcactgcgaggtgctgtacttctccatcgccttcgtcatcctgaagttcacccttggtcctctcggacccaagggtcagtctcgaatgaagtttgtgttcaccaactacaacctgctcatgtccatctactcgctgggctccttcctctctatggcctacgccatgtacaccattggtgtcatgtccgacaactgcgagaaggctttcgacaacaatgtcttccgaatcaccactcagctgttctacctcagcaagttcctcgagtacattgactccttctatctgcccctcatgggcaagcctctgacctggttgcagttctttcaccatctcggagctcctatggacatgtggctgttctacaactaccgaaacgaagccgtttggatctttgtgctgctcaacggcttcattcactggatcatgtacggctactattggacccgactgatcaagctcaagttccctatgcccaagtccctgattacttctatgcagatcattcagttcaacgttggcttctacatcgtctggaagtaccggaacattccctgctaccgacaagatgggatgagaatgtttggctggtttttcaactacttctacgttggtactgtcctgtgtctgttcctcaacttctacgtgcagacctacatcgtccgaaagcacaagggagccaaaaagattcagtga

SEQ ID NO: 119 - protein, 258 aa, Euglena gracilis
MEVVNEIVSIGQEVLPKVDYAQLWSDASHCEVLYFSIAFVILKFTLGPLGPKGQSRMKFVFTNYNLLMSIYSLGSFLSMAYAMYTIGVMSDNCEKAFDNNVFRITTQLFYLSKFLEYIDSFYLPLMGKPLTWLQFFHHLGAPMDMWLFYNYRNEAVWIFVLLNGFIHWIMYGYYWTRLIKLKFPMPKSLITSMQIIQFNVGFYIVWKYRNIPCYRQDGMRMFGWFFNYFYVGTVLCLFLNFYVQTYIVRKHKGAKKIQ

SEQ ID NO: 120 - DNA, 7769 bp, Artificial Sequence
  Plasmid pZUFmEgD9eS-L35F
ggccgcaagtgtggatggggaagtgagtgcccggttctgtgtgcacaattggcaatccaagatggatggattcaacacagggatatagcgagctacgtggtggtgcgaggatatagcaacggatatttatgtttgacacttgagaatgtacgatacaagcactgtccaagtacaatactaaacatactgtacatactcatactcgtacccgggcaacggtttcacttgagtgcagtggctagtgctcttactcgtacagtgtgcaatactgcgtatcatagtctttgatgtatatcgtattcattcatgttagttgcgtacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggtaccgggccccccctcgaggtcgatggtgtcgataagcttgatatcgaattcatgtcacacaaaccgatcttcgcctcaaggaaacctaattctacatccgagagactgccgagatccagtctacactgattaattttcgggccaataatttaaaaaaatcgtgttatataatattatatgtattatatatatacatcatgatgatactgacagtcatgtcccattgctaaatagacagactccatctgccgcctccaactgatgttctcaatatttaaggggtcatctcgcattgtttaataataaacagactccatctaccgcctccaaatgatgttctcaaaatatattgtatgaacttatttttattacttagtattattagacaacttacttgctttatgaaaaacacttcctatttaggaaacaatttataatggcagttcgttcatttaacaatttatgtagaataaatgttataaatgcgtatgggaaatcttaaatatggatagcataaatgatatctgcattgcctaattcgaaatcaacagcaacgaaaaaaatcccttgtacaacataaatagtcatcgagaaatatcaactatcaaagaacagctattcacacgttactattgagattattattggacgagaatcacacactcaactgtctttctctcttctagaaatacaggtacaagtatgtactattctcattgttcatacttctagtcatttcatcccacatattccttggatttctctccaatgaatgacattctatcttgcaaattcaacaattataataagatataccaaagtagcggtatagtggcaatcaaaaagcttctctggtgtgcttctcgtatttatttttattctaatgatccattaaaggtatatatttatttcttgttatataatccttttgtttattacatgggctggatacataaaggtattttgatttaattttttgcttaaattcaatcccccctcgttcagtgtcaactgtaatggtaggaaattaccatacttttgaagaagcaaaaaaaatgaaagaaaaaaaaaatcgtatttccaggttagacgttccgcagaatctagaatgcggtatgcggtacattgttcttcgaacgtaaaagttgcgctccctgagatattgtacatttttgcttttacaagtacaagtacatcgtacaactatgtactactgttgatgcatccacaacagtttgttttgtttttttttgttttttttttttctaatgattcattaccgctatgtatacctacttgtacttgtagtaagccgggttattggcgttcaattaatcatagacttatgaatctgcacggtgtgcgctgcgagttacttttagcttatgcatgctacttgggtgtaatattgggatctgttcggaaatcaacggatgctcaatcgatttcgacagtaattaattaagtcatacacaagtcagctttcttcgagcctcatataagtataagtagttcaacgtattagcactgtacccagcatctccgtatcgagaaacacaacaacatgccccattggacagatcatgcggatacacaggttgtgcagtatcatacatactcgatcagacaggtcgtctgaccatcatacaagctgaacaagcgctccatacttgcacgctctctatatacacagttaaattacatatccatagtctaacctctaacagttaatcttctggtaagcctcccagccagccttctggtatcgcttggcctcctcaataggatctcggttctggccgtacagacctcggccgacaattatgatatccgttccggtagacatgacatcctcaacagttcggtactgctgtccgagagcgtctcccttgtcgtcaagacccaccccgggggtcagaataagccagtcctcagagtcgcccttaggtcggttctgggcaatgaagccaaccacaaactcggggtcggatcgggcaagctcaatggtctgcttggagtactcgccagtggccagagagcccttgcaagacagctcggccagcatgagcagacctctggccagcttctcgttgggagaggggactaggaactccttgtactgggagttctcgtagtcagagacgtcctccttcttctgttcagagacagtttcctcggcaccagctcgcaggccagcaatgattccggttccgggtacaccgtgggcgttggtgatatcggaccactcggcgattcggtgacaccggtactggtgcttgacagtgttgccaatatctgcgaactttctgtcctcgaacaggaagaaaccgtgcttaagagcaagttccttgagggggagcacagtgccggcgtaggtgaagtcgtcaatgatgtcgatatgggttttgatcatgcacacataaggtccgaccttatcggcaagctcaatgagctccttggtggtggtaacatccagagaagcacacaggttggttttcttggctgccacgagcttgagcactcgagcggcaaaggcggacttgtggacgttagctcgagcttcgtaggagggcattttggtggtgaagaggagactgaaataaatttagtctgcagaactttttatcggaaccttatctggggcagtgaagtatatgttatggtaatagttacgagttagttgaacttatagatagactggactatacggctatcggtccaaattagaaagaacgtcaatggctctctgggcgtcgcctttgccgacaaaaatgtgatcatgatgaaagccagcaatgacgttgcagctgatattgttgtcggccaaccgcgccgaaaacgcagctgtcagacccacagcctccaacgaagaatgtatcgtcaaagtgatccaagcacactcatagttggagtcgtactccaaaggcggcaatgacgagtcagacagatactcgtcgacgtttaaacagtgtacgcagatctactatagaggaacatttaaattgccccggagaagacggccaggccgcctagatgacaaattcaacaactcacagctgactttctgccattgccactaggggggggcctttttatatggccaagccaagctctccacgtcggttgggctgcacccaacaataaatgggtagggttgcaccaacaaagggatgggatggggggtagaagatacgaggataacggggctcaatggcacaaataagaacgaatactgccattaagactcgtgatccagcgactgacaccattgcatcatctaagggcctcaaaactacctcggaactgctgcgctgatctggacaccacagaggttccgagcactttaggttgcaccaaatgtcccaccaggtgcaggcagaaaacgctggaacagcgtgtacagtttgtcttaacaaaaagtgagggcgctgaggtcgagcagggtggtgtgacttgttatagcctttagagctgcgaaagcgcgtatggatttggctcatcaggccagattgagggtctgtggacacatgtcatgttagtgtacttcaatcgccccctggatatagccccgacaataggccgtggcctcatttttttgccttccgcacatttccattgctcgatacccacaccttgcttctcctgcacttgccaaccttaatactggtttacattgaccaacatcttacaagcggggggcttgtctagggtatatataaacagtggctctcccaatcggttgccagtctcttttttcctttctttccccacagattcgaaatctaaactacacatcacagaattccgagccgtgagtatccacgacaagatcagtgtcgagacgacgcgttttgtgtaatgacacaatccgaaagtcgctagcaacacacactctctacacaaactaacccagctctggtaccatggaggtcgtgaacgaaatcgtctccattggccaggaggttcttcccaaggtcgactatgctcagctctggtctgatgcctcgcactgcgaggtgctgtacttctccatcgccttcgtcatcctgaagttcacccttggtcctctcggacccaagggtcagtctcgaatgaagtttgtgttcaccaactacaacctgctcatgtccatctactcgctgggctccttcctctctatggcctacgccatgtacaccattggtgtcatgtccgacaactgcgagaaggctttcgacaacaatgtcttccgaatcaccactcagctgttctacctcagcaagttcctcgagtacattgactccttctatctgcccctcatgggcaagcctctgacctggttgcagttctttcaccatctcggagctcctatggacatgtggctgttctacaactaccgaaacgaagccgtttggatctttgtgctgctcaacggcttcattcactggatcatgtacggctactattggacccgactgatcaagctcaagttccctatgcccaagtccctgattacttctatgcagatcattcagttcaacgttggcttctacatcgtctggaagtaccggaacattccctgctaccgacaagatgggatgagaatgtttggctggtttttcaactacttctacgttggtactgtcctgtgtctgttcctcaacttctacgtgcagacctacatcgtccgaaagcacaagggagccaaaaagattcagtgagc

SEQ ID NO: 121 - DNA, 777 bp, Euglena gracilis
  CDS (1)..(777): mutant delta-9 elongase "EgD9eS-K58R/I257T"
atggaggtcgtgaacgaaatcgtctccattggccaggaggttcttcccaaggtcgactatgctcagctctggtctgatgcctcgcactgcgaggtgctgtacctctccatcgccttcgtcatcctgaagttcacccttggtcctctcggacccaagggtcagtctcgaatgaggtttgtgttcaccaactacaacctgctcatgtccatctactcgctgggctccttcctctcgatggcctacgccatgtacaccattggtgtcatgtccgacaactgcgagaaggctttcgacaacaatgtcttccgaatcaccactcagctgttctacctcagcaagttcctcgagtacattgactccttctatctgcccctcatgggcaagcctctgacctggttgcaattctttcaccatctcggagctcctatggacatgtggctgttctacaactaccgaaacgaagccgtttggatctttgtgctgctcaacggcttcattcactggatcatgtacggctactattggacccgactgatcaagctcaagttccctatgcccaagtccctgattacttctatgcagatcattcagttcaacgttggcttctacatcgtctggaagtaccggaacattccctgctaccgacaagatggaatgagaatgtttggctggtttttcaactacttctacgttggtactgtcctgtgtctgttcctcaacttctacgtgcagacctacatcgtccgaaagcacaagggagccaaaaagactcagtga

SEQ ID NO: 122 - protein, 258 aa, Euglena gracilis
MEVVNEIVSIGQEVLPKVDYAQLWSDASHCEVLYLSIAFVILKFTLGPLGPKGQSRMRFVFTNYNLLMSIYSLGSFLSMAYAMYTIGVMSDNCEKAFDNNVFRITTQLFYLSKFLEYIDSFYLPLMGKPLTWLQFFHHLGAPMDMWLFYNYRNEAVWIFVLLNGFIHWIMYGYYWTRLIKLKFPMPKSLITSMQIIQFNVGFYIVWKYRNIPCYRQDGMRMFGWFFNYFYVGTVLCLFLNFYVQTYIVRKHKGAKKTQ

SEQ ID NO: 123 - DNA, 7769 bp, Artificial Sequence
  Plasmid pZuFmEgD9eS-K58R/I257T
ggccgcaagtgtggatggggaagtgagtgcccggttctgtgtgcacaattggcaatccaagatggatggattcaacacagggatatagcgagctacgtggtggtgcgaggatatagcaacggatatttatgtttgacacttgagaatgtacgatacaagcactgtccaagtacaatactaaacatactgtacatactcatactcgtacccgggcaacggtttcacttgagtgcagtggctagtgctcttactcgtacagtgtgcaatactgcgtatcatagtctttgatgtatatcgtattcattcatgttagttgcgtacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggtaccgggccccccctcgaggtcgatggtgtcgataagcttgatatcgaattcatgtcacacaaaccgatcttcgcctcaaggaaacctaattctacatccgagagactgccgagatccagtctacactgattaattttcgggccaataatttaaaaaaatcgtgttatataatattatatgtattatatatatacatcatgatgatactgacagtcatgtcccattgctaaatagacagactccatctgccgcctccaactgatgttctcaatatttaaggggtcatctcgcattgtttaataataaacagactccatctaccgcctccaaatgatgttctcaaaatatattgtatgaacttatttttattacttagtattattagacaacttacttgctttatgaaaaacacttcctatttaggaaacaatttataatggcagttcgttcatttaacaatttatgtagaataaatgttataaatgcgtatgggaaatcttaaatatggatagcataaatgatatctgcattgcctaattcgaaatcaacagcaacgaaaaaaatcccttgtacaacataaatagtcatcgagaaatatcaactatcaaagaacagctattcacacgttactattgagattattattggacgagaatcacacactcaactgtctttctctcttctagaaatacaggtacaagtatgtactattctcattgttcatacttctagtcatttcatcccacatattccttggatttctctccaatgaatgacattctatcttgcaaattcaacaattataataagatataccaaagtagcggtatagtggcaatcaaaaagcttctctggtgtgcttctcgtatttatttttattctaatgatccattaaaggtatatatttatttcttgttatataatccttttgtttattacatgggctggatacataaaggtattttgatttaattttttgcttaaattcaatcccccctcgttcagtgtcaactgtaatggtaggaaattaccatacttttgaagaagcaaaaaaaatgaaagaaaaaaaaaatcgtatttccaggttagacgttccgcagaatctagaatgcggtatgcggtacattgttcttcgaacgtaaaagttgcgctccctgagatattgtacatttttgcttttacaagtacaagtacatcgtacaactatgtactactgttgatgcatccacaacagtttgttttgtttttttttgttttttttttttctaatgattcattaccgctatgtatacctacttgtacttgtagtaagccgggttattggcgttcaattaatcatagacttatgaatctgcacggtgtgcgctgcgagttacttttagcttatgcatgctacttgggtgtaatattgggatctgttcggaaatcaacggatgctcaatcgatttcgacagtaattaattaagtcatacacaagtcagctttcttcgagcctcatataagtataagtagttcaacgtattagcactgtacccagcatctccgtatcgagaaacacaacaacatgccccattggacagatcatgcggatacacaggttgtgcagtatcatacatactcgatcagacaggtcgtctgaccatcatacaagctgaacaagcgctccatacttgcacgctctctatatacacagttaaattacatatccatagtctaacctctaacagttaatcttctggtaagcctcccagccagccttctggtatcgcttggcctcctcaataggatctcggttctggccgtacagacctcggccgacaattatgatatccgttccggtagacatgacatcctcaacagttcggtactgctgtccgagagcgtctcccttgtcgtcaagacccaccccgggggtcagaataagccagtcctcagagtcgcccttaggtcggttctgggcaatgaagccaaccacaaactcggggtcggatcgggcaagctcaatggtctgcttggagtactcgccagtggccagagagcccttgcaagacagctcggccagcatgagcagacctctggccagcttctcgttgggagaggggactaggaactccttgtactgggagttctcgtagtcagagacgtcctccttcttctgttcagagacagtttcctcggcaccagctcgcaggccagcaatgattccggttccgggtacaccgtgggcgttggtgatatcggaccactcggcgattcggtgacaccggtactggtgcttgacagtgttgccaatatctgcgaactttctgtcctcgaacaggaagaaaccgtgcttaagagcaagttccttgagggggagcacagtgccggcgtaggtgaagtcgtcaatgatgtcgatatgggttttgatcatgcacacataaggtccgaccttatcggcaagctcaatgagctccttggtggtggtaacatccagagaagcacacaggttggttttcttggctgccacgagcttgagcactcgagcggcaaaggcggacttgtggacgttagctcgagcttcgtaggagggcattttggtggtgaagaggagactgaaataaatttagtctgcagaactttttatcggaaccttatctggggcagtgaagtatatgttatggtaatagttacgagttagttgaacttatagatagactggactatacggctatcggtccaaattagaaagaacgtcaatggctctctgggcgtcgcctttgccgacaaaaatgtgatcatgatgaaagccagcaatgacgttgcagctgatattgttgtcggccaaccgcgccgaaaacgcagctgtcagacccacagcctccaacgaagaatgtatcgtcaaagtgatccaagcacactcatagttggagtcgtactccaaaggcggcaatgacgagtcagacagatactcgtcgacgtttaaacagtgtacgcagatctactatagaggaacatttaaattgccccggagaagacggccaggccgcctagatgacaaattcaacaactcacagctgactttctgccattgccactaggggggggcctttttatatggccaagccaagctctccacgtcggttgggctgcacccaacaataaatgggtagggttgcaccaacaaagggatgggatggggggtagaagatacgaggataacggggctcaatggcacaaataagaacgaatactgccattaagactcgtgatccagcgactgacaccattgcatcatctaagggcctcaaaactacctcggaactgctgcgctgatctggacaccacagaggttccgagcactttaggttgcaccaaatgtcccaccaggtgcaggcagaaaacgctggaacagcgtgtacagtttgtcttaacaaaaagtgagggcgctgaggtcgagcagggtggtgtgacttgttatagcctttagagctgcgaaagcgcgtatggatttggctcatcaggccagattgagggtctgtggacacatgtcatgttagtgtacttcaatcgccccctggatatagccccgacaataggccgtggcctcatttttttgccttccgcacatttccattgctcgatacccacaccttgcttctcctgcacttgccaaccttaatactggtttacattgaccaacatcttacaagcggggggcttgtctagggtatatataaacagtggctctcccaatcggttgccagtctcttttttcctttctttccccacagattcgaaatctaaactacacatcacagaattccgagccgtgagtatccacgacaagatcagtgtcgagacgacgcgttttgtgtaatgacacaatccgaaagtcgctagcaacacacactctctacacaaactaacccagctctggtaccatggaggtcgtgaacgaaatcgtctccattggccaggaggttcttcccaaggtcgactatgctcagctctggtctgatgcctcgcactgcgaggtgctgtacctctccatcgccttcgtcatcctgaagttcacccttggtcctctcggacccaagggtcagtctcgaatgaggtttgtgttcaccaactacaacctgctcatgtccatctactcgctgggctccttcctctcgatggcctacgccatgtacaccattggtgtcatgtccgacaactgcgagaaggctttcgacaacaatgtcttccgaatcaccactcagctgttctacctcagcaagttcctcgagtacattgactccttctatctgcccctcatgggcaagcctctgacctggttgcaattctttcaccatctcggagctcctatggacatgtggctgttctacaactaccgaaacgaagccgtttggatctttgtgctgctcaacggcttcattcactggatcatgtacggctactattggacccgactgatcaagctcaagttccctatgcccaagtccctgattacttctatgcagatcattcagttcaacgttggcttctacatcgtctggaagtaccggaacattccctgctaccgacaagatggaatgagaatgtttggctggtttttcaactacttctacgttggtactgtcctgtgtctgttcctcaacttctacgtgcagacctacatcgtccgaaagcacaagggagccaaaaagactcagtgagc

SEQ ID NO: 124 - DNA, 777 bp, Euglena gracilis
  CDS (1)..(777): mutant delta-9 elongase "EgD9eS-L130M/V243A1"
atggaggtcgtgaacgaaatcgtctccattggccaggaggttcttcccaaggtcgactatgctcagctctggtctgatgcctcgcactgcgaggtgctgtacctctccatcgccttcgtcatcctgaagttcacccttggtcctctcggacccaagggtcagtctcgaatgaagtttgtgttcaccaactacaacctgctcatgtccatctactcgctgggctccttcctctctatggcctacgccatgtacaccattggtgtcatgtccgacaactgcgagaaggctttcgacaacaatgtcttccgaatcaccactcagctgttctacctcagcaagttcctcgagtacattgactccttctatctgcccctcatgggcaagcctatgacctggttgcagttctttcaccatctcggagctcctatggacatgtggctgttctacaattaccgaaacgaagccgtttggatctttgtgctgctcaacggcttcattcactggatcatgtacggctactattggacccgactgatcaagctcaagttccctatgcccaagtccctgattacttctatgcagatcattcagttcaacgttggcttctacatcgtctggaagtaccggaacattccctgctaccgacaagatggaatgagaatgtttggctggtttttcaactacttctacgttggtactgtcctgtgtctgttcctcaacttctacgcgcagacctacatcgtccgaaagcacaagggagccaaaaagattcagtga

SEQ ID NO: 125 - protein, 258 aa, Euglena gracilis
MEVVNEIVSIGQEVLPKVDYAQLWSDASHCEVLYLSIAFVILKFTLGPLGPKGQSRMKFVFTNYNLLMSIYSLGSFLSMAYAMYTIGVMSDNCEKAFDNNVFRITTQLFYLSKFLEYIDSFYLPLMGKPMTWLQFFHHLGAPMDMWLFYNYRNEAVWIFVLLNGFIHWIMYGYYWTRLIKLKFPMPKSLITSMQIIQFNVGFYIVWKYRNIPCYRQDGMRMFGWFFNYFYVGTVLCLFLNFYAQTYIVRKHKGAKKIQ

SEQ ID NO: 126 - DNA, 7769 bp, Artificial Sequence
  Plasmid pZuFmEgD9eS-L130M/V243A1
ggccgcaagtgtggatggggaagtgagtgcccggttctgtgtgcacaattggcaatccaagatggatggattcaacacagggatatagcgagctacgtggtggtgcgaggatatagcaacggatatttatgtttgacacttgagaatgtacgatacaagcactgtccaagtacaatactaaacatactgtacatactcatactcgtacccgggcaacggtttcacttgagtgcagtggctagtgctcttactcgtacagtgtgcaatactgcgtatcatagtctttgatgtatatcgtattcattcatgttagttgcgtacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggtaccgggccccccctcgaggtcgatggtgtcgataagcttgatatcgaattcatgtcacacaaaccgatcttcgcctcaaggaaacctaattctacatccgagagactgccgagatccagtctacactgattaattttcgggccaataatttaaaaaaatcgtgttatataatattatatgtattatatatatacatcatgatgatactgacagtcatgtcccattgctaaatagacagactccatctgccgcctccaactgatgttctcaatatttaaggggtcatctcgcattgtttaataataaacagactccatctaccgcctccaaatgatgttctcaaaatatattgtatgaacttatttttattacttagtattattagacaacttacttgctttatgaaaaacacttcctatttaggaaacaatttataatggcagttcgttcatttaacaatttatgtagaataaatgttataaatgcgtatgggaaatcttaaatatggatagcataaatgatatctgcattgcctaattcgaaatcaacagcaacgaaaaaaatcccttgtacaacataaatagtcatcgagaaatatcaactatcaaagaacagctattcacacgttactattgagattattattggacgagaatcacacactcaactgtctttctctcttctagaaatacaggtacaagtatgtactattctcattgttcatacttctagtcatttcatcccacatattccttggatttctctccaatgaatgacattctatcttgcaaattcaacaattataataagatataccaaagtagcggtatagtggcaatcaaaaagcttctctggtgtgcttctcgtatttatttttattctaatgatccattaaaggtatatatttatttcttgttatataatccttttgtttattacatgggctggatacataaaggtattttgatttaattttttgcttaaattcaatcccccctcgttcagtgtcaactgtaatggtaggaaattaccatacttttgaagaagcaaaaaaaatgaaagaaaaaaaaaatcgtatttccaggttagacgttccgcagaatctagaatgcggtatgcggtacattgttcttcgaacgtaaaagttgcgctccctgagatattgtacatttttgcttttacaagtacaagtacatcgtacaactatgtactactgttgatgcatccacaacagtttgttttgtttttttttgttttttttttttctaatgattcattaccgctatgtatacctacttgtacttgtagtaagccgggttattggcgttcaattaatcatagacttatgaatctgcacggtgtgcgctgcgagttacttttagcttatgcatgctacttgggtgtaatattgggatctgttcggaaatcaacggatgctcaatcgatttcgacagtaattaattaagtcatacacaagtcagctttcttcgagcctcatataagtataagtagttcaacgtattagcactgtacccagcatctccgtatcgagaaacacaacaacatgccccattggacagatcatgcggatacacaggttgtgcagtatcatacatactcgatcagacaggtcgtctgaccatcatacaagctgaacaagcgctccatacttgcacgctctctatatacacagttaaattacatatccatagtctaacctctaacagttaatcttctggtaagcctcccagccagccttctggtatcgcttggcctcctcaataggatctcggttctggccgtacagacctcggccgacaattatgatatccgttccggtagacatgacatcctcaacagttcggtactgctgtccgagagcgtctcccttgtcgtcaagacccaccccgggggtcagaataagccagtcctcagagtcgcccttaggtcggttctgggcaatgaagccaaccacaaactcggggtcggatcgggcaagctcaatggtctgcttggagtactcgccagtggccagagagcccttgcaagacagctcggccagcatgagcagacctctggccagcttctcgttgggagaggggactaggaactccttgtactgggagttctcgtagtcagagacgtcctccttcttctgttcagagacagtttcctcggcaccagctcgcaggccagcaatgattccggttccgggtacaccgtgggcgttggtgatatcggaccactcggcgattcggtgacaccggtactggtgcttgacagtgttgccaatatctgcgaactttctgtcctcgaacaggaagaaaccgtgcttaagagcaagttccttgagggggagcacagtgccggcgtaggtgaagtcgtcaatgatgtcgatatgggttttgatcatgcacacataaggtccgaccttatcggcaagctcaatgagctccttggtggtggtaacatccagagaagcacacaggttggttttcttggctgccacgagcttgagcactcgagcggcaaaggcggacttgtggacgttagctcgagcttcgtaggagggcattttggtggtgaagaggagactgaaataaatttagtctgcagaactttttatcggaaccttatctggggcagtgaagtatatgttatggtaatagttacgagttagttgaacttatagatagactggactatacggctatcggtccaaattagaaagaacgtcaatggctctctgggcgtcgcctttgccgacaaaaatgtgatcatgatgaaagccagcaatgacgttgcagctgatattgttgtcggccaaccgcgccgaaaacgcagctgtcagacccacagcctccaacgaagaatgtatcgtcaaagtgatccaagcacactcatagttggagtcgtactccaaaggcggcaatgacgagtcagacagatactcgtcgacgtttaaacagtgtacgcagatctactatagaggaacatttaaattgccccggagaagacggccaggccgcctagatgacaaattcaacaactcacagctgactttctgccattgccactaggggggggcctttttatatggccaagccaagctctccacgtcggttgggctgcacccaacaataaatgggtagggttgcaccaacaaagggatgggatggggggtagaagatacgaggataacggggctcaatggcacaaataagaacgaatactgccattaagactcgtgatccagcgactgacaccattgcatcatctaagggcctcaaaactacctcggaactgctgcgctgatctggacaccacagaggttccgagcactttaggttgcaccaaatgtcccaccaggtgcaggcagaaaacgctggaacagcgtgtacagtttgtcttaacaaaaagtgagggcgctgaggtcgagcagggtggtgtgacttgttatagcctttagagctgcgaaagcgcgtatggatttggctcatcaggccagattgagggtctgtggacacatgtcatgttagtgtacttcaatcgccccctggatatagccccgacaataggccgtggcctcatttttttgccttccgcacatttccattgctcgatacccacaccttgcttctcctgcacttgccaaccttaatactggtttacattgaccaacatcttacaagcggggggcttgtctagggtatatataaacagtggctctcccaatcggttgccagtctcttttttcctttctttccccacagattcgaaatctaaactacacatcacagaattccgagccgtgagtatccacgacaagatcagtgtcgagacgacgcgttttgtgtaatgacacaatccgaaagtcgctagcaacacacactctctacacaaactaacccagctctggtaccatggaggtcgtgaacgaaatcgtctccattggccaggaggttcttcccaaggtcgactatgctcagctctggtctgatgcctcgcactgcgaggtgctgtacctctccatcgccttcgtcatcctgaagttcacccttggtcctctcggacccaagggtcagtctcgaatgaagtttgtgttcaccaactacaacctgctcatgtccatctactcgctgggctccttcctctctatggcctacgccatgtacaccattggtgtcatgtccgacaactgcgagaaggctttcgacaacaatgtcttccgaatcaccactcagctgttctacctcagcaagttcctcgagtacattgactccttctatctgcccctcatgggcaagcctatgacctggttgcagttctttcaccatctcggagctcctatggacatgtggctgttctacaattaccgaaacgaagccgtttggatctttgtgctgctcaacggcttcattcactggatcatgtacggctactattggacccgactgatcaagctcaagttccctatgcccaagtccctgattacttctatgcagatcattcagttcaacgttggcttctacatcgtctggaagtaccggaacattccctgctaccgacaagatggaatgagaatgtttggctggtttttcaactacttctacgttggtactgtcctgtgtctgttcctcaacttctacgcgcagacctacatcgtccgaaagcacaagggagccaaaaagattcagtgagc

SEQ ID NO: 127 - DNA, 777 bp, Euglena gracilis
  CDS (1)..(777): mutant delta-9 elongase "EgD9eS-D98G"
atggaggtcgtgaacgaaatcgtctccattggccaggaggttcttcccaaggtcgactatgctcagctctggtctgatgcctcgcactgcgaggtgctgtacctctccatcgccttcgtcatcctgaagttcacccttggtcctctcggacccaagggtcagtctcgaatgaagtttgtgttcaccaactacaacctgctcatgtccatctactcgctgggctccttcctctctatggcctacgccatgtacaccattggtgtcatgtccgacaactgcgagaaggctttcggcaacaatgtcttccgaatcaccactcagctgttctacctcagcaagttcctcgagtacattgactccttctatctgcccctcatgggcaagcctctgacctggttgcagttctttcaccatctcggagctcctatggacatgtggctgttctacaactaccgaaacgaagccgtttggatctttgtgctgctcaacggcttcattcactggatcatgtacggctactattggacccgactgatcaagctcaagttccctatgcccaagtccctgattacttctatgcagatcattcagttcaacgttggcttctacatcgtctggaagtaccggaacattccctgctaccgacaagatggaatgagaatgtttggctggtttttcaactacttctacgttggtactgtcctgtgtctgttcctcaacttctacgtgcagacctacatcgtccgaaagcacaagggagccaaaaagattcagtga

SEQ ID NO: 128 - protein, 258 aa, Euglena gracilis
MEVVNEIVSIGQEVLPKVDYAQLWSDASHCEVLYLSIAFVILKFTLGPLGPKGQSRMKFVFTNYNLLMSIYSLGSFLSMAYAMYTIGVMSDNCEKAFGNNVFRITTQLFYLSKFLEYIDSFYLPLMGKPLTWLQFFHHLGAPMDMWLFYNYRNEAVWIFVLLNGFIHWIMYGYYWTRLIKLKFPMPKSLITSMQIIQFNVGFYIVWKYRNIPCYRQDGMRMFGWFFNYFYVGTVLCLFLNFYVQTYIVRKHKGAKKIQ

SEQ ID NO: 129 - DNA, 7769 bp, Artificial Sequence
  Plasmid pZuFmEgD9eS-D98G
ggccgcaagtgtggatggggaagtgagtgcccggttctgtgtgcacaattggcaatccaagatggatggattcaacacagggatatagcgagctacgtggtggtgcgaggatatagcaacggatatttatgtttgacacttgagaatgtacgatacaagcactgtccaagtacaatactaaacatactgtacatactcatactcgtacccgggcaacggtttcacttgagtgcagtggctagtgctcttactcgtacagtgtgcaatactgcgtatcatagtctttgatgtatatcgtattcattcatgttagttgcgtacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggtaccgggccccccctcgaggtcgatggtgtcgataagcttgatatcgaattcatgtcacacaaaccgatcttcgcctcaaggaaacctaattctacatccgagagactgccgagatccagtctacactgattaattttcgggccaataatttaaaaaaatcgtgttatataatattatatgtattatatatatacatcatgatgatactgacagtcatgtcccattgctaaatagacagactccatctgccgcctccaactgatgttctcaatatttaaggggtcatctcgcattgtttaataataaacagactccatctaccgcctccaaatgatgttctcaaaatatattgtatgaacttatttttattacttagtattattagacaacttacttgctttatgaaaaacacttcctatttaggaaacaatttataatggcagttcgttcatttaacaatttatgtagaataaatgttataaatgcgtatgggaaatcttaaatatggatagcataaatgatatctgcattgcctaattcgaaatcaacagcaacgaaaaaaatcccttgtacaacataaatagtcatcgagaaatatcaactatcaaagaacagctattcacacgttactattgagattattattggacgagaatcacacactcaactgtctttctctcttctagaaatacaggtacaagtatgtactattctcattgttcatacttctagtcatttcatcccacatattccttggatttctctccaatgaatgacattctatcttgcaaattcaacaattataataagatataccaaagtagcggtatagtggcaatcaaaaagcttctctggtgtgcttctcgtatttatttttattctaatgatccattaaaggtatatatttatttcttgttatataatccttttgtttattacatgggctggatacataaaggtattttgatttaattttttgcttaaattcaatcccccctcgttcagtgtcaactgtaatggtaggaaattaccatacttttgaagaagcaaaaaaaatgaaagaaaaaaaaaatcgtatttccaggttagacgttccgcagaatctagaatgcggtatgcggtacattgttcttcgaacgtaaaagttgcgctccctgagatattgtacatttttgcttttacaagtacaagtacatcgtacaactatgtactactgttgatgcatccacaacagtttgttttgtttttttttgttttttttttttctaatgattcattaccgctatgtatacctacttgtacttgtagtaagccgggttattggcgttcaattaatcatagacttatgaatctgcacggtgtgcgctgcgagttacttttagcttatgcatgctacttgggtgtaatattgggatctgttcggaaatcaacggatgctcaatcgatttcgacagtaattaattaagtcatacacaagtcagctttcttcgagcctcatataagtataagtagttcaacgtattagcactgtacccagcatctccgtatcgagaaacacaacaacatgccccattggacagatcatgcggatacacaggttgtgcagtatcatacatactcgatcagacaggtcgtctgaccatcatacaagctgaacaagcgctccatacttgcacgctctctatatacacagttaaattacatatccatagtctaacctctaacagttaatcttctggtaagcctcccagccagccttctggtatcgcttggcctcctcaataggatctcggttctggccgtacagacctcggccgacaattatgatatccgttccggtagacatgacatcctcaacagttcggtactgctgtccgagagcgtctcccttgtcgtcaagacccaccccgggggtcagaataagccagtcctcagagtcgcccttaggtcggttctgggcaatgaagccaaccacaaactcggggtcggatcgggcaagctcaatggtctgcttggagtactcgccagtggccagagagcccttgcaagacagctcggccagcatgagcagacctctggccagcttctcgttgggagaggggactaggaactccttgtactgggagttctcgtagtcagagacgtcctccttcttctgttcagagacagtttcctcggcaccagctcgcaggccagcaatgattccggttccgggtacaccgtgggcgttggtgatatcggaccactcggcgattcggtgacaccggtactggtgcttgacagtgttgccaatatctgcgaactttctgtcctcgaacaggaagaaaccgtgcttaagagcaagttccttgagggggagcacagtgccggcgtaggtgaagtcgtcaatgatgtcgatatgggttttgatcatgcacacataaggtccgaccttatcggcaagctcaatgagctccttggtggtggtaacatccagagaagcacacaggttggttttcttggctgccacgagcttgagcactcgagcggcaaaggcggacttgtggacgttagctcgagcttcgtaggagggcattttggtggtgaagaggagactgaaataaatttagtctgcagaactttttatcggaaccttatctggggcagtgaagtatatgttatggtaatagttacgagttagttgaacttatagatagactggactatacggctatcggtccaaattagaaagaacgtcaatggctctctgggcgtcgcctttgccgacaaaaatgtgatcatgatgaaagccagcaatgacgttgcagctgatattgttgtcggccaaccgcgccgaaaacgcagctgtcagacccacagcctccaacgaagaatgtatcgtcaaagtgatccaagcacactcatagttggagtcgtactccaaaggcggcaatgacgagtcagacagatactcgtcgacgtttaaacagtgtacgcagatctactatagaggaacatttaaattgccccggagaagacggccaggccgcctagatgacaaattcaacaactcacagctgactttctgccattgccactaggggggggcctttttatatggccaagccaagctctccacgtcggttgggctgcacccaacaataaatgggtagggttgcaccaacaaagggatgggatggggggtagaagatacgaggataacggggctcaatggcacaaataagaacgaatactgccattaagactcgtgatccagcgactgacaccattgcatcatctaagggcctcaaaactacctcggaactgctgcgctgatctggacaccacagaggttccgagcactttaggttgcaccaaatgtcccaccaggtgcaggcagaaaacgctggaacagcgtgtacagtttgtcttaacaaaaagtgagggcgctgaggtcgagcagggtggtgtgacttgttatagcctttagagctgcgaaagcgcgtatggatttggctcatcaggccagattgagggtctgtggacacatgtcatgttagtgtacttcaatcgccccctggatatagccccgacaataggccgtggcctcatttttttgccttccgcacatttccattgctcgatacccacaccttgcttctcctgcacttgccaaccttaatactggtttacattgaccaacatcttacaagcggggggcttgtctagggtatatataaacagtggctctcccaatcggttgccagtctcttttttcctttctttccccacagattcgaaatctaaactacacatcacagaattccgagccgtgagtatccacgacaagatcagtgtcgagacgacgcgttttgtgtaatgacacaatccgaaagtcgctagcaacacacactctctacacaaactaacccagctctggtaccatggaggtcgtgaacgaaatcgtctccattggccaggaggttcttcccaaggtcgactatgctcagctctggtctgatgcctcgcactgcgaggtgctgtacctctccatcgccttcgtcatcctgaagttcacccttggtcctctcggacccaagggtcagtctcgaatgaagtttgtgttcaccaactacaacctgctcatgtccatctactcgctgggctccttcctctctatggcctacgccatgtacaccattggtgtcatgtccgacaactgcgagaaggctttcggcaacaatgtcttccgaatcaccactcagctgttctacctcagcaagttcctcgagtacattgactccttctatctgcccctcatgggcaagcctctgacctggttgcagttctttcaccatctcggagctcctatggacatgtggctgttctacaactaccgaaacgaagccgtttggatctttgtgctgctcaacggcttcattcactggatcatgtacggctactattggacccgactgatcaagctcaagttccctatgcccaagtccctgattacttctatgcagatcattcagttcaacgttggcttctacatcgtctggaagtaccggaacattccctgctaccgacaagatggaatgagaatgtttggctggtttttcaactacttctacgttggtactgtcctgtgtctgttcctcaacttctacgtgcagacctacatcgtccgaaagcacaagggagccaaaaagattcagtgagc

SEQ ID NO: 130 - DNA, 777 bp, Euglena gracilis
  CDS (1)..(777): mutant delta-9 elongase "EgD9eS-L130M/V243A2"
atggaggtcgtgaacgaaattgtctccattggccaggaggttcttcccaaggtcgactatgctcagctctggtctgatgcctcgcactgcgaggtgctgtacctctccatcgccttcgtcatcctgaagttcacccttggtcctctcggacccaagggtcagtctcgaatgaagtttgtgttcaccaactacaacctgctcatgtccatctactcgctgggctccttcctctctatggcctacgccatgtacaccattggtgtcatgtccgacaactgcgagaaggctttcgacaacaatgtcttccgaatcaccactcagctgttctacctcagcaagttcctcgagtacattgactccttctatctgcccctcatgggcaagcctatgacctggttgcagttctttcaccatctcggagctcctatggacatgtggctgttctacaattaccgaaacgaagccgtttggatctttgtgctgctcaacggcttcattcactggatcatgtacggctactattggacccgactgatcaagctcaagttccctatgcccaagtccctgattacttctatgcagatcattcagttcaacgttggcttctacatcgtctggaagtaccggaacattccctgctaccgacaagatggaatgagaatgtttggctggtttttcaactacttctacgttggtactgtcctgtgtctgttcctcaacttctacgcgcagacctacatcgtccgaaagcacaagggagccaaaaagattcagtga

SEQ ID NO: 131 - protein, 258 aa, Euglena gracilis; identical to SEQ ID NO: 125

SEQ ID NO: 132 - DNA, 7769 bp, Artificial Sequence
  Plasmid pZuFmEgD9eS-L130M/V243A2
ggccgcaagtgtggatggggaagtgagtgcccggttctgtgtgcacaattggcaatccaagatggatggattcaacacagggatatagcgagctacgtggtggtgcgaggatatagcaacggatatttatgtttgacacttgagaatgtacgatacaagcactgtccaagtacaatactaaacatactgtacatactcatactcgtacccgggcaacggtttcacttgagtgcagtggctagtgctcttactcgtacagtgtgcaatactgcgtatcatagtctttgatgtatatcgtattcattcatgttagttgcgtacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggtaccgggccccccctcgaggtcgatggtgtcgataagcttgatatcgaattcatgtcacacaaaccgatcttcgcctcaaggaaacctaattctacatccgagagactgccgagatccagtctacactgattaattttcgggccaataatttaaaaaaatcgtgttatataatattatatgtattatatatatacatcatgatgatactgacagtcatgtcccattgctaaatagacagactccatctgccgcctccaactgatgttctcaatatttaaggggtcatctcgcattgtttaataataaacagactccatctaccgcctccaaatgatgttctcaaaatatattgtatgaacttatttttattacttagtattattagacaacttacttgctttatgaaaaacacttcctatttaggaaacaatttataatggcagttcgttcatttaacaatttatgtagaataaatgttataaatgcgtatgggaaatcttaaatatggatagcataaatgatatctgcattgcctaattcgaaatcaacagcaacgaaaaaaatcccttgtacaacataaatagtcatcgagaaatatcaactatcaaagaacagctattcacacgttactattgagattattattggacgagaatcacacactcaactgtctttctctcttctagaaatacaggtacaagtatgtactattctcattgttcatacttctagtcatttcatcccacatattccttggatttctctccaatgaatgacattctatcttgcaaattcaacaattataataagatataccaaagtagcggtatagtggcaatcaaaaagcttctctggtgtgcttctcgtatttatttttattctaatgatccattaaaggtatatatttatttcttgttatataatccttttgtttattacatgggctggatacataaaggtattttgatttaattttttgcttaaattcaatcccccctcgttcagtgtcaactgtaatggtaggaaattaccatacttttgaagaagcaaaaaaaatgaaagaaaaaaaaaatcgtatttccaggttagacgttccgcagaatctagaatgcggtatgcggtacattgttcttcgaacgtaaaagttgcgctccctgagatattgtacatttttgcttttacaagtacaagtacatcgtacaactatgtactactgttgatgcatccacaacagtttgttttgtttttttttgttttttttttttctaatgattcattaccgctatgtatacctacttgtacttgtagtaagccgggttattggcgttcaattaatcatagacttatgaatctgcacggtgtgcgctgcgagttacttttagcttatgcatgctacttgggtgtaatattgggatctgttcggaaatcaacggatgctcaatcgatttcgacagtaattaattaagtcatacacaagtcagctttcttcgagcctcatataagtataagtagttcaacgtattagcactgtacccagcatctccgtatcgagaaacacaacaacatgccccattggacagatcatgcggatacacaggttgtgcagtatcatacatactcgatcagacaggtcgtctgaccatcatacaagctgaacaagcgctccatacttgcacgctctctatatacacagttaaattacatatccatagtctaacctctaacagttaatcttctggtaagcctcccagccagccttctggtatcgcttggcctcctcaataggatctcggttctggccgtacagacctcggccgacaattatgatatccgttccggtagacatgacatcctcaacagttcggtactgctgtccgagagcgtctcccttgtcgtcaagacccaccccgggggtcagaataagccagtcctcagagtcgcccttaggtcggttctgggcaatgaagccaaccacaaactcggggtcggatcgggcaagctcaatggtctgcttggagtactcgccagtggccagagagcccttgcaagacagctcggccagcatgagcagacctctggccagcttctcgttgggagaggggactaggaactccttgtactgggagttctcgtagtcagagacgtcctccttcttctgttcagagacagtttcctcggcaccagctcgcaggccagcaatgattccggttccgggtacaccgtgggcgttggtgatatcggaccactcggcgattcggtgacaccggtactggtgcttgacagtgttgccaatatctgcgaactttctgtcctcgaacaggaagaaaccgtgcttaagagcaagttccttgagggggagcacagtgccggcgtaggtgaagtcgtcaatgatgtcgatatgggttttgatcatgcacacataaggtccgaccttatcggcaagctcaatgagctccttggtggtggtaacatccagagaagcacacaggttggttttcttggctgccacgagcttgagcactcgagcggcaaaggcggacttgtggacgttagctcgagcttcgtaggagggcattttggtggtgaagaggagactgaaataaatttagtctgcagaactttttatcggaaccttatctggggcagtgaagtatatgttatggtaatagttacgagttagttgaacttatagatagactggactatacggctatcggtccaaattagaaagaacgtcaatggctctctgggcgtcgcctttgccgacaaaaatgtgatcatgatgaaagccagcaatgacgttgcagctgatattgttgtcggccaaccgcgccgaaaacgcagctgtcagacccacagcctccaacgaagaatgtatcgtcaaagtgatccaagcacactcatagttggagtcgtactccaaaggcggcaatgacgagtcagacagatactcgtcgacgtttaaacagtgtacgcagatctactatagaggaacatttaaattgccccggagaagacggccaggccgcctagatgacaaattcaacaactcacagctgactttctgccattgccactaggggggggcctttttatatggccaagccaagctctccacgtcggttgggctgcacccaacaataaatgggtagggttgcaccaacaaagggatgggatggggggtagaagatacgaggataacggggctcaatggcacaaataagaacgaatactgccattaagactcgtgatccagcgactgacaccattgcatcatctaagggcctcaaaactacctcggaactgctgcgctgatctggacaccacagaggttccgagcactttaggttgcaccaaatgtcccaccaggtgcaggcagaaaacgctggaacagcgtgtacagtttgtcttaacaaaaagtgagggcgctgaggtcgagcagggtggtgtgacttgttatagcctttagagctgcgaaagcgcgtatggatttggctcatcaggccagattgagggtctgtggacacatgtcatgttagtgtacttcaatcgccccctggatatagccccgacaataggccgtggcctcatttttttgccttccgcacatttccattgctcgatacccacaccttgcttctcctgcacttgccaaccttaatactggtttacattgaccaacatcttacaagcggggggcttgtctagggtatatataaacagtggctctcccaatcggttgccagtctcttttttcctttctttccccacagattcgaaatctaaactacacatcacagaattccgagccgtgagtatccacgacaagatcagtgtcgagacgacgcgttttgtgtaatgacacaatccgaaagtcgctagcaacacacactctctacacaaactaacccagctctggtaccatggaggtcgtgaacgaaattgtctccattggccaggaggttcttcccaaggtcgactatgctcagctctggtctgatgcctcgcactgcgaggtgctgtacctctccatcgccttcgtcatcctgaagttcacccttggtcctctcggacccaagggtcagtctcgaatgaagtttgtgttcaccaactacaacctgctcatgtccatctactcgctgggctccttcctctctatggcctacgccatgtacaccattggtgtcatgtccgacaactgcgagaaggctttcgacaacaatgtcttccgaatcaccactcagctgttctacctcagcaagttcctcgagtacattgactccttctatctgcccctcatgggcaagcctatgacctggttgcagttctttcaccatctcggagctcctatggacatgtggctgttctacaattaccgaaacgaagccgtttggatctttgtgctgctcaacggcttcattcactggatcatgtacggctactattggacccgactgatcaagctcaagttccctatgcccaagtccctgattacttctatgcagatcattcagttcaacgttggcttctacatcgtctggaagtaccggaacattccctgctaccgacaagatggaatgagaatgtttggctggtttttcaactacttctacgttggtactgtcctgtgtctgttcctcaacttctacgcgcagacctacatcgtccgaaagcacaagggagccaaaaagattcagtgagc

SEQ ID NO: 133 - protein, 289 aa, Ciona intestinalis
MDVLHRFLGFYEWTLTFADPRVAKWPLIENPLPTIAIVLLYLAFVLYIGPRFMRKRAPVDFGLFLPGYNFALVALNYYILQEVVTGSYGAGYDLVCTPLRSDSYDPNEMKVANAVWWYYVSKIIELFDTVLFTLRKRDRQVTFLHVYHHSTMPLLWWIGAKWVPGGQSFVGIILNSSVHVIMYTYYGLSALGPHMQKFLWWKKYITMLQLVQFVLAIYHTARSLYVKCPSPVWMHWALILYAFSFILLFSNFYMHAYIKKSRKGKENGSRGKGGVSNGKEKLHANGKTD

SEQ ID NO: 134 - protein, 295 aa, Oncorhynchus mykiss
METFNYKLNMYIDSWMGPRDERVQGWLLLDNYPPTFALTVMYLLIVWMGPKYMRHRQPVSCRGLLLVYNLGLTILSFYMFYEMVSAVWHGDYNFFCQDTHSAGETDTKIINVLWWYYFSKLIEFMDTFFFILRKNNHQITFLHIYHHASMLNIWWFVMNWVPCGHSYFGASLNSFIHVLMYSYYGLSAVPALRPYLWWKKYITQVQLIQFFLTMSQTICAVIWPCDFPRGWLYFQIFYVITLIALFSNFYIQTYKKHLVSQKKEYHQNGSVASLNGHVNGVTPTETITHRKVRGD

SEQ ID NO: 135 - protein, 290 aa, Marchantia polymorpha
MEAYEMVDSFVSKTVFETLQRLRGGVVLTESAITKGLPCVDSPTPIVLGLSSYLTFVFLGLIVIKSLDLKPRSKEPAILNLFVIFHNFVCFALSLYMCVGIVRQAILNRYSLWGNAYNPKEVQMGHLLYIFYMSKYIEFMDTVIMILKRNTRQITVLHVYHHASISFIWWIIAYHAPGGEAYFSAALNSGVHVLMYLYYLLAATLGKNEKARRKYLWWGKYLTQLQMFQFVLNMIQAYYDIKNNSPYPQFLIQILFYYMISLLALFGNFYVHKYVSAPAKPAKIKSKKAE

SEQ ID NO: 136 - protein, 290 aa, Physcomitrella patens
MEVVERFYGELDGKVSQGVNALLGSFGVELTDTPTTKGLPLVDSPTPIVLGVSVYLTIVIGGLLWIKARDLKPRASEPFLLQALVLVHNLFCFALSLYMCVGIAYQAITWRYSLWGNAYNPKHKEMAILVYLFYMSKYVEFMDTVIMILKRSTRQISFLHVYHHSSISLIWWAIAHHAPGGEAYWSAALNSGVHVLMYAYYFLAACLRSSPKLKNKYLFWGRYLTQFQMFQFMLNLVQAYYDMKTNAPYPQWLIKILFYYMISLLFLFGNFYVQKYIKPSDGKQKGAKTE

SEQ ID NO: 137 - protein, 348 aa, Marchantia polymorpha
MATKSGSGLLEWIAVAAKMKQARSSPEGEIVGGNRMGSGNGAEWTTSLIHAFLNATNGKSGGASKVRPLEERIGEAVFRVLEDVVGVDIRKPNPVTKDLPMVESPVPVLACISLYLLVVWLWSSHIKASGQKPRKEDPLALRCLVIAHNLFLCCLSLFMCVGLIAAARHYGYSVWGNYYREREPAMNLLIYVFYMSKLYEFMDTAIMLFRRNLRQVTYLHVYHHASIAMIWWIICYRFPGADSYFSAAFNSCIHVAMYLYYLLAATVARDEKRRRKYLFWGKYLTIIQMLQFLSFIGQAIYAMWKFEYYPKGFGRMLFFYSVSLLAFFGNFFVKKYSNASQPKTVKVE

SEQ ID NO: 138 - protein, 292 aa, Ostreococcus tauri
MSGLRAPNFLHRFWTKWDYAISKVVFTCADSFQWDIGPVSSSTAHLPAIESPTPLVTSLLFYLVTVFLWYGRLTRSSDKKIREPTWLRRFIICHNAFLIVLSLYMCLGCVAQAYQNGYTLWGNEFKATETQLALYIYIFYVSKIYEFVDTYIMLLKNNLRQVSFLHIYHHSTISFIWWIIARRAPGGDAYFSAALNSWVHVCMYTYYLLSTLIGKEDPKRSNYLWWGRHLTQMQMLQFFFNVLQALYCASFSTYPKFLSKILLVYMMSLLGLFGHFYYSKHIAAAKLQKKQQ

SEQ ID NO: 139 - protein, 277 aa, Pavlova sp.
MMLAAGYLLVLSAARQSFQQDIDNPNGAYSTSWTGLPIVMSVVYLSGVFGLTKYFENRKPMTGLKDYMFTYNLYQVIINVWCVVAFLLEVRRAGMSLIGNKVDLGPNSFRLGFVTWVHYNNKYVELLDTLWMVLRKKTQQVSFLHVYHHVLLMWAWFVVVKLGNGGDAYFGGLMNSIIHVMMYSYYTMALLGWSCPWKRYLTQAQLVQFCICLAHSTWAAVTGAYPWRICLVEVWVMVSMLVLFTRFYRQAYAKEAKAKEAKKLAQEASQAKAVKAE

SEQ ID NO: 140 - protein, 302 aa, Rebecca salina
MKAAAGKVQQEAERLTAGLWLPMMLAAGYLLVLSANRASFYENINNEKGAYSTSWFSLPCVMTAVYLGGVFGLTKYFEGRKPMQGLKDYMFTYNLYQVIINVWCIAAFVVEVRRAGMSAVGNKVDLGPNSFRLGFVTWVHYNNKYVELLDTLWMVLRKKTQQVSFLHVYHHVLLIWAWFCVVKFCNGGDAYFGGMLNSIIHVMMYSYYTMALLGWSCPWKRYLTQAQLVQFCICLAHATWAAATGVYPFHICLVEIWVMVSMLYLFTKFYNSAYKGAAKGAAASSNGAAAPSGAKPKSIKAN

SEQ ID NO: 141 - protein, 300 aa, Ostreococcus tauri
MSASGALLPAIASAAYAYATYAYAFEWSHANGIDNVDAREWIGALSLRLPAIATTMYLLFCLVGPRLMAKREAFDPKGFMLAYNAYQTAFNVVVLGMFAREISGLGQPVWGSTMPWSDRKSFKILLGVWLHYNNKYLELLDTVFMVARKKTKQLSFLHVYHHALLIWAWWLVCHLMATNDCIDAYFGAACNSFIHIVMYSYYLMSALGIRCPWKRYITQAQMLQFVIVFAHAVFVLRQKHCPVTLPWAQMFVMTNMLVLFGNFYLKAYSNKSRGDGASSVKPAETTRAPSVRRTRSRKID

SEQ ID NO: 142 - protein, 358 aa, Thalassiosira pseudonana
MCSSPPSQSKTTSLLARYTTAALLLLTLTTWCHFAFPAATATPGLTAEMHSYKVPLGLTVFYLLSLPSLKYVTDNYLAKKYDMKSLLTESMVLYNVAQVLLNGWTVYAIVDAVMNRDHPFIGSRSLVGAALHSGSSYAVWVHYCDKYLEFFDTYFMVLRGKMDQVSFLHIYHHTTIAWAWWIALRFSPGGDIYFGALLNSIIHVLMYSYYALALLKVSCPWKRYLTQAQLLQFTSVVVYTGCTGYTHYYHTKHGADETQPSLGTYYFCCGVQVFEMVSLFVLFSIFYKRSYSKKNKSGGKDSKKNDDGNNEDQCHKAMKDISEGAKEVVGHAAKDAGKLVATASKAVKRKGTRVTGAM

SEQ ID NO: 143 - protein, 272 aa, Thalassiosira pseudonana
MDAYNAAMDKIGAAIIDWSDPDGKFRADREDWWLCDFRSAITIALIYIAFVILGSAVMQSLPAMDPYPIKFLYNVSQIFLCAYMTVEAGFLAYRNGYTVMPCNHFNVNDPPVANLLWLFYISKVWDFWDTIFIVLGKKWRQLSFLHVYHHTTIFLFYWLNANVLYDGDIFLTILLNGFIHTVMYTYYFICMHTKDSKTGKSLPIWWKSSLTAFQLLQFTIMMSQATYLVFHGCDKVSLRITIVYFVSLLSLFFLFAQFFVQSYMAPKKKKSA

SEQ ID NO: 144 - protein, 318 aa, Mortierella alpina
MESIAPFLPSKMPQDLFMDLATAIGVRAAPYVDPLEAALVAQAEKYIPTIVHHTRGFLVAVESPLARELPLMNPFHVLLIVLAYLVTVFVGMQIMKNFERFEVKTFSLLHNFCLVSISAYMCGGILYEAYQANYGLFENAADHTFKGLPMAKMIWLFYFSKIMEFVDTMIMVLKKNNRQISFLHVYHHSSIFTIWWLVTFVAPNGEAYFSAALNSFIHVIMYGYYFLSALGFKQVSFIKFYITRSQMTQFCMMSVQSSWDMYAMKVLGRPGYPFFITALLWFYMWTMLGLFYNFYRKNAKLAKQAKADAAKEKARKLQ

SEQ ID NO: 145 - protein, 271 aa, Thraustochytrium sp.
MMEPLDRYRALAELAARYASSAAFKWQVTYDAKDSFVGPLGIREPLGLLVGSVVLYLSLQAVVYALRNYLGGLMALRSVHNLGLCLFSGAVWIYTSYLMIQDGHFRSLEAATCEPLKHPHFQLISLLFALSKIWEWFDTVLLIVKGNKLRFLHVLHHATTFWLYAIDHIFLSSIKYGVAVNAFIHTVMYAHYFRPFPKGLRPLITQLQIVQFIFSIGIHTAIYWHYDCEPLVHTHFWEYVTPYLFVVPFLILFLNFYLQQYVLAPAKTKKA

SEQ ID NO: 146 - DNA, 23 bp, Artificial Sequence
  Primer EgD9E_102_053008f
  misc_feature (10)..(11): n is a, c, g, or t
gtgctgtacnnktccatcgcctt

SEQ ID NO: 147 - DNA, 24 bp, Artificial Sequence
  Primer EgD9E_760_053008r
tcccttgtgctttcggacgatgta

SEQ ID NO: 148 - DNA, 7769 bp, Artificial Sequence
  Plasmid pZuFmEgD9ES-L35G
ggccgcaagtgtggatggggaagtgagtgcccggttctgtgtgcacaattggcaatccaagatggatggattcaacacagggatatagcgagctacgtggtggtgcgaggatatagcaacggatatttatgtttgacacttgagaatgtacgatacaagcactgtccaagtacaatactaaacatactgtacatactcatactcgtacccgggcaacggtttcacttgagtgcagtggctagtgctcttactcgtacagtgtgcaatactgcgtatcatagtctttgatgtatatcgtattcattcatgttagttgcgtacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggtaccgggccccccctcgaggtcgatggtgtcgataagcttgatatcgaattcatgtcacacaaaccgatcttcgcctcaaggaaacctaattctacatccgagagactgccgagatccagtctacactgattaattttcgggccaataatttaaaaaaatcgtgttatataatattatatgtattatatatatacatcatgatgatactgacagtcatgtcccattgctaaatagacagactccatctgccgcctccaactgatgttctcaatatttaaggggtcatctcgcattgtttaataataaacagactccatctaccgcctccaaatgatgttctcaaaatatattgtatgaacttatttttattacttagtattattagacaacttacttgctttatgaaaaacacttcctatttaggaaacaatttataatggcagttcgttcatttaacaatttatgtagaataaatgttataaatgcgtatgggaaatcttaaatatggatagcataaatgatatctgcattgcctaattcgaaatcaacagcaacgaaaaaaatcccttgtacaacataaatagtcatcgagaaatatcaactatcaaagaacagctattcacacgttactattgagattattattggacgagaatcacacactcaactgtctttctctcttctagaaatacaggtacaagtatgtactattctcattgttcatacttctagtcatttcatcccacatattccttggatttctctccaatgaatgacattctatcttgcaaattcaacaattataataagatataccaaagtagcggtatagtggcaatcaaaaagcttctctggtgtgcttctcgtatttatttttattctaatgatccattaaaggtatatatttatttcttgttatataatccttttgtttattacatgggctggatacataaaggtattttgatttaattttttgcttaaattcaatcccccctcgttcagtgtcaactgtaatggtaggaaattaccatacttttgaagaagcaaaaaaaatgaaagaaaaaaaaaatcgtatttccaggttagacgttccgcagaatctagaatgcggtatgcggtacattgttcttcgaacgtaaaagttgcgctccctgagatattgtacatttttgcttttacaagtacaagtacatcgtacaactatgtactactgttgatgcatccacaacagtttgttttgtttttttttgttttttttttttctaatgattcattaccgctatgtatacctacttgtacttgtagtaagccgggttattggcgttcaattaatcatagacttatgaatctgcacggtgtgcgctgcgagttacttttagcttatgcatgctacttgggtgtaatattgggatctgttcggaaatcaacggatgctcaatcgatttcgacagtaattaattaagtcatacacaagtcagctttcttcgagcctcatataagtataagtagttcaacgtattagcactgtacccagcatctccgtatcgagaaacacaacaacatgccccattggacagatcatgcggatacacaggttgtgcagtatcatacatactcgatcagacaggtcgtctgaccatcatacaagctgaacaagcgctccatacttgcacgctctctatatacacagttaaattacatatccatagtctaacctctaacagttaatcttctggtaagcctcccagccagccttctggtatcgcttggcctcctcaataggatctcggttctggccgtacagacctcggccgacaattatgatatccgttccggtagacatgacatcctcaacagttcggtactgctgtccgagagcgtctcccttgtcgtcaagacccaccccgggggtcagaataagccagtcctcagagtcgcccttaggtcggttctgggcaatgaagccaaccacaaactcggggtcggatcgggcaagctcaatggtctgcttggagtactcgccagtggccagagagcccttgcaagacagctcggccagcatgagcagacctctggccagcttctcgttgggagaggggactaggaactccttgtactgggagttctcgtagtcagagacgtcctccttcttctgttcagagacagtttcctcggcaccagctcgcaggccagcaatgattccggttccgggtacaccgtgggcgttggtgatatcggaccactcggcgattcggtgacaccggtactggtgcttgacagtgttgccaatatctgcgaactttctgtcctcgaacaggaagaaaccgtgcttaagagcaagttccttgagggggagcacagtgccggcgtaggtgaagtcgtcaatgatgtcgatatgggttttgatcatgcacacataaggtccgaccttatcggcaagctcaatgagctccttggtggtggtaacatccagagaagcacacaggttggttttcttggctgccacgagcttgagcactcgagcggcaaaggcggacttgtggacgttagctcgagcttcgtaggagggcattttggtggtgaagaggagactgaaataaatttagtctgcagaactttttatcggaaccttatctggggcagtgaagtatatgttatggtaatagttacgagttagttgaacttatagatagactggactatacggctatcggtccaaattagaaagaacgtcaatggctctctgggcgtcgcctttgccgacaaaaatgtgatcatgatgaaagccagcaatgacgttgcagctgatattgttgtcggccaaccgcgccgaaaacgcagctgtcagacccacagcctccaacgaagaatgtatcgtcaaagtgatccaagcacactcatagttggagtcgtactccaaaggcggcaatgacgagtcagacagatactcgtcgacgtttaaacagtgtacgcagatctactatagaggaacatttaaattgccccggagaagacggccaggccgcctagatgacaaattcaacaactcacagctgactttctgccattgccactaggggggggcctttttatatggccaagccaagctctccacgtcggttgggctgcacccaacaataaatgggtagggttgcaccaacaaagggatgggatggggggtagaagatacgaggataacggggctcaatggcacaaataagaacgaatactgccattaagactcgtgatccagcgactgacaccattgcatcatctaagggcctcaaaactacctcggaactgctgcgctgatctggacaccacagaggttccgagcactttaggttgcaccaaatgtcccaccaggtgcaggcagaaaacgctggaacagcgtgtacagtttgtcttaacaaaaagtgagggcgctgaggtcgagcagggtggtgtgacttgttatagcctttagagctgcgaaagcgcgtatggatttggctcatcaggccagattgagggtctgtggacacatgtcatgttagtgtacttcaatcgccccctggatatagccccgacaataggccgtggcctcatttttttgccttccgcacatttccattgctcgatacccacaccttgcttctcctgcacttgccaaccttaatactggtttacattgaccaacatcttacaagcggggggcttgtctagggtatatataaacagtggctctcccaatcggttgccagtctcttttttcctttctttccccacagattcgaaatctaaactacacatcacagaattccgagccgtgagtatccacgacaagatcagtgtcgagacgacgcgttttgtgtaatgacacaatccgaaagtcgctagcaacacacactctctacacaaactaacccagctctggtaccatggaggtcgtgaacgaaatcgtctccattggccaggaggttcttcccaaggtcgactatgctcagctctggtctgatgcctcgcactgcgaggtgctgtacgggtccatcgccttcgtcatcctgaagttcacccttggtcctctcggacccaagggtcagtctcgaatgaagtttgtgttcaccaactacaacctgctcatgtccatctactcgctgggctccttcctctctatggcctacgccatgtacaccattggtgtcatgtccgacaactgcgagaaggctttcgacaacaatgtcttccgaatcaccactcagctgttctacctcagcaagttcctcgagtacattgactccttctatctgcccctcatgggcaagcctctgacctggttgcagttctttcaccatctcggagctcctatggacatgtggctgttctacaactaccgaaacgaagccgtttggatctttgtgctgctcaacggcttcattcactggatcatgtacggctactattggacccgactgatcaagctcaagttccctatgcccaagtccctgattacttctatgcagatcattcagttcaacgttggcttctacatcgtctggaagtaccggaacattccctgctaccgacaagatggaatgagaatgtttggctggtttttcaactacttctacgttggtactgtcctgtgtctgttcctcaacttctacgtgcagacctacatcgtccgaaagcacaagggagccaaaaagattcagtgagc

SEQ ID NO: 149 - DNA, 777 bp, Euglena gracilis
  CDS (1)..(777): mutant delta-9 elongase "EgD9eS-L35M/Q107E"
atggaggtcgtgaacgaaatcgtctccattggccaggaggttcttcccaaggtcgactatgctcagctctggtctgatgcctcgcactgcgaggtgctgtacatgtccatcgccttcgtcatcctgaagttcacccttggtcctctcggacccaagggtcagtctcgaatgaagtttgtgttcaccaactacaacctgctcatgtccatctactcgctgggctccttcctctctatggcctacgccatgtacaccattggtgtcatgtccgacaactgcgagaaggctttcgacaacaatgtcttccgaatcaccactgagctgttctacctcagcaagttcctcgagtacattgactccttctatctgcccctcatgggcaagcctctgacctggttgcagttctttcaccatctcggagctcctatggacatgtggctgttctacaactaccgaaacgaagccgtttggatctttgtgctgctcaacggcttcattcactggatcatgtacggctactattggacccgactgatcaagctcaagttccctatgcccaagtccctgattacttctatgcagatcattcagttcaacgttggcttctacatcgtctggaagtaccggaacattccctgctaccgacaagatggaatgagaatgtttggctggtttttcaactacttctacgttggtactgtcctgtgtctgttcctcaacttctacgtgcagacctacatcgtccgaaagcacaagggagccaaaaagattcagtga

SEQ ID NO: 150 - protein, 258 aa, Euglena gracilis
MEVVNEIVSIGQEVLPKVDYAQLWSDASHCEVLYMSIAFVILKFTLGPLGPKGQSRMKFVFTNYNLLMSIYSLGSFLSMAYAMYTIGVMSDNCEKAFDNNVFRITTELFYLSKFLEYIDSFYLPLMGKPLTWLQFFHHLGAPMDMWLFYNYRNEAVWIFVLLNGFIHWIMYGYYWTRLIKLKFPMPKSLITSMQIIQFNVGFYIVWKYRNIPCYRQDGMRMFGWFFNYFYVGTVLCLFLNFYVQTYIVRKHKGAKKIQ

SEQ ID NO: 151 - DNA, 7769 bp, Artificial Sequence
  Plasmid pZuFmEgD9ES-L35M/Q107E
ggccgcaagtgtggatggggaagtgagtgcccggttctgtgtgcacaattggcaatccaagatggatggattcaacacagggatatagcgagctacgtggtggtgcgaggatatagcaacggatatttatgtttgacacttgagaatgtacgatacaagcactgtccaagtacaatactaaacatactgtacatactcatactcgtacccgggcaacggtttcacttgagtgcagtggctagtgctcttactcgtacagtgtgcaatactgcgtatcatagtctttgatgtatatcgtattcattcatgttagttgcgtacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggtaccgggccccccctcgaggtcgatggtgtcgataagcttgatatcgaattcatgtcacacaaaccgatcttcgcctcaaggaaacctaattctacatccgagagactgccgagatccagtctacactgattaattttcgggccaataatttaaaaaaatcgtgttatataatattatatgtattatatatatacatcatgatgatactgacagtcatgtcccattgctaaatagacagactccatctgccgcctccaactgatgttctcaatatttaaggggtcatctcgcattgtttaataataaacagactccatctaccgcctccaaatgatgttctcaaaatatattgtatgaacttatttttattacttagtattattagacaacttacttgctttatgaaaaacacttcctatttaggaaacaatttataatggcagttcgttcatttaacaatttatgtagaataaatgttataaatgcgtatgggaaatcttaaatatggatagcataaatgatatctgcattgcctaattcgaaatcaacagcaacgaaaaaaatcccttgtacaacataaatagtcatcgagaaatatcaactatcaaagaacagctattcacacgttactattgagattattattggacgagaatcacacactcaactgtctttctctcttctagaaatacaggtacaagtatgtactattctcattgttcatacttctagtcatttcatcccacatattccttggatttctctccaatgaatgacattctatcttgcaaattcaacaattataataagatataccaaagtagcggtatagtggcaatcaaaaagcttctctggtgtgcttctcgtatttatttttattctaatgatccattaaaggtatatatttatttcttgttatataatccttttgtttattacatgggctggatacataaaggtattttgatttaattttttgcttaaattcaatcccccctcgttcagtgtcaactgtaatggtaggaaattaccatacttttgaagaagcaaaaaaaatgaaagaaaaaaaaaatcgtatttccaggttagacgttccgcagaatctagaatgcggtatgcggtacattgttcttcgaacgtaaaagttgcgctccctgagatattgtacatttttgcttttacaagtacaagtacatcgtacaactatgtactactgttgatgcatccacaacagtttgttttgtttttttttgttttttttttttctaatgattcattaccgctatgtatacctacttgtacttgtagtaagccgggttattggcgttcaattaatcatagacttatgaatctgcacggtgtgcgctgcgagttacttttagcttatgcatgctacttgggtgtaatattgggatctgttcggaaatcaacggatgctcaatcgatttcgacagtaattaattaagtcatacacaagtcagctttcttcgagcctcatataagtataagtagttcaacgtattagcactgtacccagcatctccgtatcgagaaacacaacaacatgccccattggacagatcatgcggatacacaggttgtgcagtatcatacatactcgatcagacaggtcgtctgaccatcatacaagctgaacaagcgctccatacttgcacgctctctatatacacagttaaattacatatccatagtctaacctctaacagttaatcttctggtaagcctcccagccagccttctggtatcgcttggcctcctcaataggatctcggttctggccgtacagacctcggccgacaattatgatatccgttccggtagacatgacatcctcaacagttcggtactgctgtccgagagcgtctcccttgtcgtcaagacccaccccgggggtcagaataagccagtcctcagagtcgcccttaggtcggttctgggcaatgaagccaaccacaaactcggggtcggatcgggcaagctcaatggtctgcttggagtactcgccagtggccagagagcccttgcaagacagctcggccagcatgagcagacctctggccagcttctcgttgggagaggggactaggaactccttgtactgggagttctcgtagtcagagacgtcctccttcttctgttcagagacagtttcctcggcaccagctcgcaggccagcaatgattccggttccgggtacaccgtgggcgttggtgatatcggaccactcggcgattcggtgacaccggtactggtgcttgacagtgttgccaatatctgcgaactttctgtcctcgaacaggaagaaaccgtgcttaagagcaagttccttgagggggagcacagtgccggcgtaggtgaagtcgtcaatgatgtcgatatgggttttgatcatgcacacataaggtccgaccttatcggcaagctcaatgagctccttggtggtggtaacatccagagaagcacacaggttggttttcttggctgccacgagcttgagcactcgagcggcaaaggcggacttgtggacgttagctcgagcttcgtaggagggcattttggtggtgaagaggagactgaaataaatttagtctgcagaactttttatcggaaccttatctggggcagtgaagtatatgttatggtaatagttacgagttagttgaacttatagatagactggactatacggctatcggtccaaattagaaagaacgtcaatggctctctgggcgtcgcctttgccgacaaaaatgtgatcatgatgaaagccagcaatgacgttgcagctgatattgttgtcggccaaccgcgccgaaaacgcagctgtcagacccacagcctccaacgaagaatgtatcgtcaaagtgatccaagcacactcatagttggagtcgtactccaaaggcggcaatgacgagtcagacagatactcgtcgacgtttaaacagtgtacgcagatctactatagaggaacatttaaattgccccggagaagacggccaggccgcctagatgacaaattcaacaactcacagctgactttctgccattgccactaggggggggcctttttatatggccaagccaagctctccacgtcggttgggctgcacccaacaataaatgggtagggttgcaccaacaaagggatgggatggggggtagaagatacgaggataacggggctcaatggcacaaataagaacgaatactgccattaagactcgtgatccagcgactgacaccattgcatcatctaagggcctcaaaactacctcggaactgctgcgctgatctggacaccacagaggttccgagcactttaggttgcaccaaatgtcccaccaggtgcaggcagaaaacgctggaacagcgtgtacagtttgtcttaacaaaaagtgagggcgctgaggtcgagcagggtggtgtgacttgttatagcctttagagctgcgaaagcgcgtatggatttggctcatcaggccagattgagggtctgtggacacatgtcatgttagtgtacttcaatcgccccctggatatagccccgacaataggccgtggcctcatttttttgccttccgcacatttccattgctcgatacccacaccttgcttctcctgcacttgccaaccttaatactggtttacattgaccaacatcttacaagcggggggcttgtctagggtatatataaacagtggctctcccaatcggttgccagtctcttttttcctttctttccccacagattcgaaatctaaactacacatcacagaattccgagccgtgagtatccacgacaagatcagtgtcgagacgacgcgttttgtgtaatgacacaatccgaaagtcgctagcaacacacactctctacacaaactaacccagctctggtaccatggaggtcgtgaacgaaatcgtctccattggccaggaggttcttcccaaggtcgactatgctcagctctggtctgatgcctcgcactgcgaggtgctgtacatgtccatcgccttcgtcatcctgaagttcacccttggtcctctcggacccaagggtcagtctcgaatgaagtttgtgttcaccaactacaacctgctcatgtccatctactcgctgggctccttcctctctatggcctacgccatgtacaccattggtgtcatgtccgacaactgcgagaaggctttcgacaacaatgtcttccgaatcaccactgagctgttctacctcagcaagttcctcgagtacattgactccttctatctgcccctcatgggcaagcctctgacctggttgcagttctttcaccatctcggagctcctatggacatgtggctgttctacaactaccgaaacgaagccgtttggatctttgtgctgctcaacggcttcattcactggatcatgtacggctactattggacccgactgatcaagctcaagttccctatgcccaagtccctgattacttctatgcagatcattcagttcaacgttggcttctacatcgtctggaagtaccggaacattccctgctaccgacaagatggaatgagaatgtttggctggtttttcaactacttctacgttggtactgtcctgtgtctgttcctcaacttctacgtgcagacctacatcgtccgaaagcacaagggagccaaaaagattcagtgagc

SEQ ID NO: 152 - DNA, 777 bp, Euglena gracilis
  misc_feature (1)..(777): mutant delta-9 elongase "EgD9eS-L35G"
atggaggtcgtgaacgaaatcgtctccattggccaggaggttcttcccaaggtcgactatgctcagctctggtctgatgcctcgcactgcgaggtgctgtacggatccatcgccttcgtcatcctgaagttcacccttggtcctctcggacccaagggtcagtctcgaatgaagtttgtgttcaccaactacaacctgctcatgtccatctactcgctgggctccttcctctctatggcctacgccatgtacaccattggtgtcatgtccgacaactgcgagaaggctttcgacaacaatgtcttccgaatcaccactcagctgttctacctcagcaagttcctcgagtacattgactccttctatctgcccctcatgggcaagcctctgacctggttgcagttctttcaccatctcggagctcctatggacatgtggctgttctacaactaccgaaacgaagccgtttggatctttgtgctgctcaacggcttcattcactggatcatgtacggctactattggacccgactgatcaagctcaagttccctatgcccaagtccctgattacttctatgcagatcattcagttcaacgttggcttctacatcgtctggaagtaccggaacattccctgctaccgacaagatggaatgagaatgtttggctggtttttcaactacttctacgttggtactgtcctgtgtctgttcctcaacttctacgtgcagacctacatcgtccgaaagcacaagggagccaaaaagattcagtga

SEQ ID NO: 153 - DNA, 777 bp, Euglena gracilis
  misc_feature (1)..(777): mutant delta-9 elongase "EgD9eS-L35G"
atggaggtcgtgaacgaaatcgtctccattggccaggaggttcttcccaaggtcgactatgctcagctctggtctgatgcctcgcactgcgaggtgctgtacggctccatcgccttcgtcatcctgaagttcacccttggtcctctcggacccaagggtcagtctcgaatgaagtttgtgttcaccaactacaacctgctcatgtccatctactcgctgggctccttcctctctatggcctacgccatgtacaccattggtgtcatgtccgacaactgcgagaaggctttcgacaacaatgtcttccgaatcaccactcagctgttctacctcagcaagttcctcgagtacattgactccttctatctgcccctcatgggcaagcctctgacctggttgcagttctttcaccatctcggagctcctatggacatgtggctgttctacaactaccgaaacgaagccgtttggatctttgtgctgctcaacggcttcattcactggatcatgtacggctactattggacccgactgatcaagctcaagttccctatgcccaagtccctgattacttctatgcagatcattcagttcaacgttggcttctacatcgtctggaagtaccggaacattccctgctaccgacaagatggaatgagaatgtttggctggtttttcaactacttctacgttggtactgtcctgtgtctgttcctcaacttctacgtgcagacctacatcgtccgaaagcacaagggagccaaaaagattcagtga

SEQ ID NO: 154 - DNA, 777 bp, Euglena gracilis
  misc_feature (1)..(777): mutant delta-9 elongase "EgD9eS-L35G"
atggaggtcgtgaacgaaatcgtctccattggccaggaggttcttcccaaggtcgactatgctcagctctggtctgatgcctcgcactgcgaggtgctgtacggttccatcgccttcgtcatcctgaagttcacccttggtcctctcggacccaagggtcagtctcgaatgaagtttgtgttcaccaactacaacctgctcatgtccatctactcgctgggctccttcctctctatggcctacgccatgtacaccattggtgtcatgtccgacaactgcgagaaggctttcgacaacaatgtcttccgaatcaccactcagctgttctacctcagcaagttcctcgagtacattgactccttctatctgcccctcatgggcaagcctctgacctggttgcagttctttcaccatctcggagctcctatggacatgtggctgttctacaactaccgaaacgaagccgtttggatctttgtgctgctcaacggcttcattcactggatcatgtacggctactattggacccgactgatcaagctcaagttccctatgcccaagtccctgattacttctatgcagatcattcagttcaacgttggcttctacatcgtctggaagtaccggaacattccctgctaccgacaagatggaatgagaatgtttggctggtttttcaactacttctacgttggtactgtcctgtgtctgttcctcaacttctacgtgcagacctacatcgtccgaaagcacaagggagccaaaaagattcagtga

SEQ ID NO: 155 - DNA, 22 bp, Artificial Sequence
  Primer Eg_9D_122709f
gaaatcgtcgacattggccagg

SEQ ID NO: 156 - DNA, 27 bp, Artificial Sequence
  Primer Eg_84C_122709r
gacaccaatggtacacatggcgtaggc

SEQ ID NO: 157 - DNA, 27 bp, Artificial Sequence
  Primer Eg_84C_122709f
gcctacgccatgtgtaccattggtgtc

SEQ ID NO: 158 - DNA, 22 bp, Artificial Sequence
  Primer Eg_9D_122709r
cctggccaatgtcgacgatttc

SEQ ID NO: 159 - DNA, 25 bp, Artificial Sequence
  Primer Eg_161T_122709f
gatctttgtgaccctcaacggcttc

SEQ ID NO: 160 - DNA, 25 bp, Artificial Sequence
  Primer Eg_179R_122709r
gaacttgagctttcgcagtcgggtc

SEQ ID NO: 161 - DNA, 25 bp, Artificial Sequence
  Primer Eg_179R_122709f
gacccgactgcgaaagctcaagttc

SEQ ID NO: 162 - DNA, 25 bp, Artificial Sequence
  Primer Eg_161T_122709r
gaagccgttgagggtcacaaagatc

SEQ ID NO: 163 - DNA, 22 bp, Artificial Sequence
  Primer Eg_244N_122709f
cttctacgtgaacacctacatc

SEQ ID NO: 164 - DNA, 23 bp, Artificial Sequence
  Primer Eg_21V_010710r
gaccagagctgcacatagtcgac

SEQ ID NO: 165 - DNA, 23 bp, Artificial Sequence
  Primer Eg_21V_010710f
gtcgactatgtgcagctctggtc

SEQ ID NO: 166 - DNA, 22 bp, Artificial Sequence
  Primer Eg_244N_122709r
gatgtaggtgttcacgtagaag

SEQ ID NO: 167 - DNA, 22 bp, Artificial Sequence
  Primer Eg_32F_010710f
gcactgcgagtttctgtacctc

SEQ ID NO: 168 - DNA, 22 bp, Artificial Sequence
  Primer Eg_108G_010710r
gaggtagaaaccctgagtggtg

SEQ ID NO: 169 - DNA, 22 bp, Artificial Sequence
  Primer Eg_108G_010710f
caccactcagggtttctacctc

SEQ ID NO: 170 - DNA, 22 bp, Artificial Sequence
  Primer Eg_32F_010710r
gaggtacagaaactcgcagtgc

SEQ ID NO: 171 - DNA, 22 bp, Artificial Sequence
  Primer Eg_132T_010710f
gcctctgaccaccttgcagttc

SEQ ID NO: 172 - DNA, 22 bp, Artificial Sequence
  Primer Eg_143N_010710r
gccacatgtcgttaggagctcc

SEQ ID NO: 173 - DNA, 22 bp, Artificial Sequence
  Primer Eg_143N_010710f
ggagctcctaacgacatgtggc

SEQ ID NO: 174 - DNA, 22 bp, Artificial Sequence
  Primer Eg_132T_010710r
gaactgcaaggtggtcagaggc

SEQ ID NO: 175 - DNA, 23 bp, Artificial Sequence
  Primer Eg_236N_010710f
gtactgtcctgaacctgttcctc

SEQ ID NO: 176 - DNA, 23 bp, Artificial Sequence
  Primer Eg_236N_010710r
gaggaacaggttcaggacagtac

SEQ ID NO: 177 - DNA, 777 bp, Euglena gracilis
  CDS (1)..(777): mutant delta-9 elongase "EgD9eS-A21V/L35G/L108G/I179R"
atggaggtcgtgaacgaaatcgtctccattggccaggaggttcttcccaaggtcgactatgtgcagctctggtctgatgcctcgcactgcgaggtgctgtacgggtccatcgccttcgtcatcctgaagttcacccttggtcctctcggacccaagggtcagtctcgaatgaagtttgtgttcaccaactacaacctgctcatgtccatctactcgctgggctccttcctctctatggcctacgccatgtacaccattggtgtcatgtccgacaactgcgagaaggctttcgacaacaatgtcttccgaatcaccactcagggtttctacctcagcaagttcctcgagtacattgactccttctatctgcccctcatgggcaagcctctgacctggttgcagttctttcaccatctcggagctcctatggacatgtggctgttctacaactaccgaaacgaagccgtttggatctttgtgctgctcaacggcttcattcactggatcatgtacggctactattggacccgactgcgaaagctcaagttccctatgcccaagtccctgattacttctatgcagatcattcagttcaacgttggcttctacatcgtctggaagtaccggaacattccctgctaccgacaagatggaatgagaatgtttggctggtttttcaactacttctacgttggtactgtcctgtgtctgttcctcaacttctacgtgcagacctacatcgtccgaaagcacaagggagccaaaaagattcagtga

SEQ ID NO: 178 - protein, 258 aa, Euglena gracilis
MEVVNEIVSIGQEVLPKVDYVQLWSDASHCEVLYGSIAFVILKFTLGPLGPKGQSRMKFVFTNYNLLMSIYSLGSFLSMAYAMYTIGVMSDNCEKAFDNNVFRITTQGFYLSKFLEYIDSFYLPLMGKPLTWLQFFHHLGAPMDMWLFYNYRNEAVWIFVLLNGFIHWIMYGYYWTRLRKLKFPMPKSLITSMQIIQFNVGFYIVWKYRNIPCYRQDGMRMFGWFFNYFYVGTVLCLFLNFYVQTYIVRKHKGAKKIQ

SEQ ID NO: 179 - DNA, 7769 bp, Artificial Sequence
  Plasmid pZuFmEgD9ES-A21V/L35G/L108G/I179R
ggccgcaagtgtggatggggaagtgagtgcccggttctgtgtgcacaattggcaatccaagatggatggattcaacacagggatatagcgagctacgtggtggtgcgaggatatagcaacggatatttatgtttgacacttgagaatgtacgatacaagcactgtccaagtacaatactaaacatactgtacatactcatactcgtacccgggcaacggtttcacttgagtgcagtggctagtgctcttactcgtacagtgtgcaatactgcgtatcatagtctttgatgtatatcgtattcattcatgttagttgcgtacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggtaccgggccccccctcgaggtcgatggtgtcgataagcttgatatcgaattcatgtcacacaaaccgatcttcgcctcaaggaaacctaattctacatccgagagactgccgagatccagtctacactgattaattttcgggccaataatttaaaaaaatcgtgttatataatattatatgtattatatatatacatcatgatgatactgacagtcatgtcccattgctaaatagacagactccatctgccgcctccaactgatgttctcaatatttaaggggtcatctcgcattgtttaataataaacagactccatctaccgcctccaaatgatgttctcaaaatatattgtatgaacttatttttattacttagtattattagacaacttacttgctttatgaaaaacacttcctatttaggaaacaatttataatggcagttcgttcatttaacaatttatgtagaataaatgttataaatgcgtatgggaaatcttaaatatggatagcataaatgatatctgcattgcctaattcgaaatcaacagcaacgaaaaaaatcccttgtacaacataaatagtcatcgagaaatatcaactatcaaagaacagctattcacacgttactattgagattattattggacgagaatcacacactcaactgtctttctctcttctagaaatacaggtacaagtatgtactattctcattgttcatacttctagtcatttcatcccacatattccttggatttctctccaatgaatgacattctatcttgcaaattcaacaattataataagatataccaaagtagcggtatagtggcaatcaaaaagcttctctggtgtgcttctcgtatttatttttattctaatgatccattaaaggtatatatttatttcttgttatataatccttttgtttattacatgggctggatacataaaggtattttgatttaattttttgcttaaattcaatcccccctcgttcagtgtcaactgtaatggtaggaaattaccatacttttgaagaagcaaaaaaaatgaaagaaaaaaaaaatcgtatttccaggttagacgttccgcagaatctagaatgcggtatgcggtacattgttcttcgaacgtaaaagttgcgctccctgagatattgtacatttttgcttttacaagtacaagtacatcgtacaactatgtactactgttgatgcatccacaacagtttgttttgtttttttttgttttttttttttctaatgattcattaccgctatgtatacctacttgtacttgtagtaagccgggttattggcgttcaattaatcatagacttatgaatctgcacggtgtgcgctgcgagttacttttagcttatgcatgctacttgggtgtaatattgggatctgttcggaaatcaacggatgctcaatcgatttcgacagtaattaattaagtcatacacaagtcagctttcttcgagcctcatataagtataagtagttcaacgtattagcactgtacccagcatctccgtatcgagaaacacaacaacatgccccattggacagatcatgcggatacacaggttgtgcagtatcatacatactcgatcagacaggtcgtctgaccatcatacaagctgaacaagcgctccatacttgcacgctctctatatacacagttaaattacatatccatagtctaacctctaacagttaatcttctggtaagcctcccagccagccttctggtatcgcttggcctcctcaataggatctcggttctggccgtacagacctcggccgacaattatgatatccgttccggtagacatgacatcctcaacagttcggtactgctgtccgagagcgtctcccttgtcgtcaagacccaccccgggggtcagaataagccagtcctcagagtcgcccttaggtcggttctgggcaatgaagccaaccacaaactcggggtcggatcgggcaagctcaatggtctgcttggagtactcgccagtggccagagagcccttgcaagacagctcggccagcatgagcagacctctggccagcttctcgttgggagaggggactaggaactccttgtactgggagttctcgtagtcagagacgtcctccttcttctgttcagagacagtttcctcggcaccagctcgcaggccagcaatgattccggttccgggtacaccgtgggcgttggtgatatcggaccactcggcgattcggtgacaccggtactggtgcttgacagtgttgccaatatctgcgaactttctgtcctcgaacaggaagaaaccgtgcttaagagcaagttccttgagggggagcacagtgccggcgtaggtgaagtcgtcaatgatgtcgatatgggttttgatcatgcacacataaggtccgaccttatcggcaagctcaatgagctccttggtggtggtaacatccagagaagcacacaggttggttttcttggctgccacgagcttgagcactcgagcggcaaaggcggacttgtggacgttagctcgagcttcgtaggagggcattttggtggtgaagaggagactgaaataaatttagtctgcagaactttttatcggaaccttatctggggcagtgaagtatatgttatggtaatagttacgagttagttgaacttatagatagactggactatacggctatcggtccaaattagaaagaacgtcaatggctctctgggcgtcgcctttgccgacaaaaatgtgatcatgatgaaagccagcaatgacgttgcagctgatattgttgtcggccaaccgcgccgaaaacgcagctgtcagacccacagcctccaacgaagaatgtatcgtcaaagtgatccaagcacactcatagttggagtcgtactccaaaggcggcaatgacgagtcagacagatactcgtcgacgtttaaacagtgtacgcagatctactatagaggaacatttaaattgccccggagaagacggccaggccgcctagatgacaaattcaacaactcacagctgactttctgccattgccactaggggggggcctttttatatggccaagccaagctctccacgtcggttgggctgcacccaacaataaatgggtagggttgcaccaacaaagggatgggatggggggtagaagatacgaggataacggggctcaatggcacaaataagaacgaatactgccattaagactcgtgatccagcgactgacaccattgcatcatctaagggcctcaaaactacctcggaactgctgcgctgatctggacaccacagaggttccgagcactttaggttgcaccaaatgtcccaccaggtgcaggcagaaaacgctggaacagcgtgtacagtttgtcttaacaaaaagtgagggcgctgaggtcgagcagggtggtgtgacttgttatagcctttagagctgcgaaagcgcgtatggatttggctcatcaggccagattgagggtctgtggacacatgtcatgttagtgtacttcaatcgccccctggatatagccccgacaataggccgtggcctcatttttttgccttccgcacatttccattgctcgatacccacaccttgcttctcctgcacttgccaaccttaatactggtttacattgaccaacatcttacaagcggggggcttgtctagggtatatataaacagtggctctcccaatcggttgccagtctcttttttcctttctttccccacagattcgaaatctaaactacacatcacagaattccgagccgtgagtatccacgacaagatcagtgtcgagacgacgcgttttgtgtaatgacacaatccgaaagtcgctagcaacacacactctctacacaaactaacccagctctggtaccatggaggtcgtgaacgaaatcgtctccattggccaggaggttcttcccaaggtcgactatgtgcagctctggtctgatgcctcgcactgcgaggtgctgtacgggtccatcgccttcgtcatcctgaagttcacccttggtcctctcggacccaagggtcagtctcgaatgaagtttgtgttcaccaactacaacctgctcatgtccatctactcgctgggctccttcctctctatggcctacgccatgtacaccattggtgtcatgtccgacaactgcgagaaggctttcgacaacaatgtcttccgaatcaccactcagggtttctacctcagcaagttcctcgagtacattgactccttctatctgcccctcatgggcaagcctctgacctggttgcagttctttcaccatctcggagctcctatggacatgtggctgttctacaactaccgaaacgaagccgtttggatctttgtgctgctcaacggcttcattcactggatcatgtacggctactattggacccgactgcgaaagctcaagttccctatgcccaagtccctgattacttctatgcagatcattcagttcaacgttggcttctacatcgtctggaagtaccggaacattccctgctaccgacaagatggaatgagaatgtttggctggtttttcaactacttctacgttggtactgtcctgtgtctgttcctcaacttctacgtgcagacctacatcgtccgaaagcacaagggagccaaaaagattcagtgagc

SEQ ID NO: 180 - protein, 4 aa, Artificial Sequence
  HXGX motif
  misc_feature (2)..(2): Xaa can be any naturally occurring amino acid
  misc_feature (4)..(4): Xaa can be any naturally occurring amino acid
HXGX

SEQ ID NO: 181 - protein, 4 aa, Artificial Sequence
  HPGG motif
HPGG

SEQ ID NO: 182 - protein, 5 aa, Artificial Sequence
  HXXXH motif
  misc_feature (2)..(4): Xaa can be any naturally occurring amino acid
HXXXH

SEQ ID NO: 183 - protein, 5 aa, Artificial Sequence
  HDASH motif
HDASH

SEQ ID NO: 184 - DNA, 1350 bp, Euglena gracilis
  CDS (1)..(1350): delta-5 desaturase
  ref <302>: TITLE: DELTA-5 DESATURASE AND ITS USE IN MAKING POLYUNSATURATED FATTY ACIDS
  ref <310>: PATENT DOCUMENT NUMBER: WO 2007/136671
  ref <311>: PATENT FILING DATE: 2007-05-16
  ref <312>: PUBLICATION DATE: 2007-11-29
  ref <313>: RELEVANT RESIDUES IN SEQ ID NO: (1)..(1350)
  ref <302>: TITLE: DELTA-5 DESATURASE AND ITS USE IN MAKING POLYUNSATURATED FATTY ACIDS
  ref <310>: PATENT DOCUMENT NUMBER: US 7,678,560
  ref <311>: PATENT FILING DATE: 2007-05-15
  ref <312>: PUBLICATION DATE: 2010-03-16
  ref <313>: RELEVANT RESIDUES IN SEQ ID NO: (1)..(1350)
atggctctcagtcttaccacagaacagctgttagaacgccctgatttggttgcgattgatggcatcctctacgaccttgaagggcttgccaaagttcatccaggaggagatttgattctcgcttctggtgcctctgatgcctcccctctcttttattcaatgcatccatacgtcaaaccggagaattccaaattgcttcaacagttcgtccgagggaagcatgaccgcacctcgaaggacattgtctacacgtatgattctcccttcgcacaagacgttaagcggacaatgcgcgaggtgatgaaagggaggaactggtacgcaacccctggcttctggctgcgcaccgttgggatcatcgccgtgacggccttttgcgagtggcactgggctaccacggggatggtgctgtggggcctgttgactggattcatgcacatgcagatcggcttatccatccagcatgatgcgtcccacggggccatcagcaagaagccttgggtcaacgccctcttcgcctacggcattgacgtcatcggatcgtcccggtggatttggctgcagtcgcacatcatgcggcaccacacctacaccaaccagcacggcctcgacctggatgcggagtcggcagagccgttcctggtgttccacaactaccccgccgcaaacaccgcccgaaagtggttccaccgcttccaagcttggtacatgtaccttgtgctgggggcatacggggtatcgctggtgtacaacccgctctacattttccggatgcagcacaatgacaccatcccagagtctgtcacggccatgcgggagaatggctttctgcggcgctaccgcacacttgcattcgtgatgcgagctttcttcatcttccggaccgcattcttgccctggtacctcactgggacctcattgctgatcaccattcctctggtgcccactgcaactggtgccttcttgacgttcttcttcattttgtcccacaattttgatggctccgaacggatccccgacaagaactgcaaggttaagagctctgagaaggacgttgaggctgaccaaattgactggtatcgggcgcaggtggagacgtcctccacatacggtggccccatcgccatgttcttcactggcggtctcaatttccagatcgagcaccacctctttccccggatgtcgtcttggcactaccccttcgtccagcaggcggtccgggagtgttgcgaacgccatggagtgcgatatgttttctaccctaccatcgtcggcaacatcatctccaccctgaagtacatgcataaggtgggtgtcgtccactgcgtgaaggacgcacaggattcctga

SEQ ID NO: 185 - protein, 449 aa, Euglena gracilis
MALSLTTEQLLERPDLVAIDGILYDLEGLAKVHPGGDLILASGASDASPLFYSMHPYVKPENSKLLQQFVRGKHDRTSKDIVYTYDSPFAQDVKRTMREVMKGRNWYATPGFWLRTVGIIAVTAFCEWHWATTGMVLWGLLTGFMHMQIGLSIQHDASHGAISKKPWVNALFAYGIDVIGSSRWIWLQSHIMRHHTYTNQHGLDLDAESAEPFLVFHNYPAANTARKWFHRFQAWYMYLVLGAYGVSLVYNPLYIFRMQHNDTIPESVTAMRENGFLRRYRTLAFVMRAFFIFRTAFLPWYLTGTSLLITIPLVPTATGAFLTFFFILSHNFDGSERIPDKNCKVKSSEKDVEADQIDWYRAQVETSSTYGGPIAMFFTGGLNFQIEHHLFPRMSSWHYPFVQQAVRECCERHGVRYVFYPTIVGNIISTLKYMHKVGVVHCVKDAQDS

SEQ ID NO: 186 - protein, 5 aa, Artificial Sequence
  His-rich motif
  misc_feature (2)..(4): Xaa can be any naturally occurring amino acid
HXXXH

SEQ ID NO: 187 - protein, 6 aa, Artificial Sequence
  His-rich motif
  misc_feature (2)..(5): Xaa can be any naturally occurring amino acid
HXXXXH

SEQ ID NO: 188 - protein, 5 aa, Artificial Sequence
  His-rich motif
  misc_feature (2)..(3): Xaa can be any naturally occurring amino acid
HXXHH

SEQ ID NO: 189 - protein, 6 aa, Artificial Sequence
  His-rich motif
  misc_feature (2)..(4): Xaa can be any naturally occurring amino acid
HXXXHH

SEQ ID NO: 190 - protein, 5 aa, Artificial Sequence
  His-rich motif
  MISC_FEATURE (1)..(1): Xaa = Gln [Q] or His [H]
  misc_feature (2)..(3): Xaa can be any naturally occurring amino acid
XXXHH

SEQ ID NO: 191 - protein, 6 aa, Artificial Sequence
  His-rich motif
  MISC_FEATURE (1)..(1): Xaa = Gln [Q] or His [H]
  misc_feature (2)..(4): Xaa can be any naturally occurring amino acid
XXXXHH

SEQ ID NO: 192 - DNA, 1350 bp, Euglena gracilis
  CDS (1)..(1350): delta-5 desaturase ("EgD5R")
atggctctcagtcttaccacagaacagctgttagaacgccctgatttggttgcgattgatggcatcctctacgaccttgaagggcttgccaaagttcatccaggaggagatttgattctcgcttctggtgcctctgatgcctcccctctcttttattcaatgcatccatacgtcaaaccggagaattccaaattgcttcaacagttcgtccgagggaagcatgaccgcacctcgaaggacattgtctacacgtatgattctcccttcgcacaagacgttaagcggacaatgcgcgaggtgatgaaagggaggaactggtacgcaacccctggcttctggctgcgcaccgttgggatcatcgccgtgacggccttttgcgagtggcactgggctaccacggggatggtgctgtggggcctgttgactggattcatgcacatgcagatcggcttatccatccagcatgatgcgtcccacggggccatcagcaagaagccttgggtcaacgccctcttcgcctacggcattgacgtcatcggatcgtcccggtggatttggctgcagtcgcacatcatgcggcaccacacctacaccaaccagcacggcctcgacctggatgcggagtcggcagagccgttcctggtgttccacaactaccccgccgcaaacaccgcccgaaagtggttccaccgcttccaagcttggtacatgtaccttgtgctgggggcatacggggtatcgctggtgtacaacccgctctacattttccggatgcagcacaatgacaccatcccagagtctgtcacggccatgcgggaaaatggctttctgcggcgctaccgcacacttgcattcgtgatgcgagctttcttcatcttccggaccgcattcttgccctggtacctcactgggacctcattgctgatcaccattcctctggtgcccaccgcaactggtgccttcttgacgttcttcttcattttgtcccacaattttgatggctccgaacggatccccgacaagaactgcaaggttaagagatctgagaaggacgttgaggctgaccaaattgactggtatcgggcgcaggtggagacgtcctccacatacggtggccccatcgccatgttcttcactggcggtctcaatttccagatcgagcaccacctctttccccggatgtcgtcttggcactaccccttcgtccagcaggcggtccgggagtgttgcgaacgccatggagtgcgatatgttttctaccctaccatcgtcggcaacatcatctccaccctgaagtacatgcataaggtgggtgtcgtccactgcgtgaaggacgcacaggattcctaa

SEQ ID NO: 193 - protein, 449 aa, Euglena gracilis
MALSLTTEQLLERPDLVAIDGILYDLEGLAKVHPGGDLILASGASDASPLFYSMHPYVKPENSKLLQQFVRGKHDRTSKDIVYTYDSPFAQDVKRTMREVMKGRNWYATPGFWLRTVGIIAVTAFCEWHWATTGMVLWGLLTGFMHMQIGLSIQHDASHGAISKKPWVNALFAYGIDVIGSSRWIWLQSHIMRHHTYTNQHGLDLDAESAEPFLVFHNYPAANTARKWFHRFQAWYMYLVLGAYGVSLVYNPLYIFRMQHNDTIPESVTAMRENGFLRRYRTLAFVMRAFFIFRTAFLPWYLTGTSLLITIPLVPTATGAFLTFFFILSHNFDGSERIPDKNCKVKRSEKDVEADQIDWYRAQVETSSTYGGPIAMFFTGGLNFQIEHHLFPRMSSWHYPFVQQAVRECCERHGVRYVFYPTIVGNIISTLKYMHKVGVVHCVKDAQDS

SEQ ID NO: 194 - DNA, 8438 bp, Artificial Sequence
  Plasmid pDMW367
catggctctcagtcttaccacagaacagctgttagaacgccctgatttggttgcgattgatggcatcctctacgaccttgaagggcttgccaaagttcatccaggaggagatttgattctcgcttctggtgcctctgatgcctcccctctcttttattcaatgcatccatacgtcaaaccggagaattccaaattgcttcaacagttcgtccgagggaagcatgaccgcacctcgaaggacattgtctacacgtatgattctcccttcgcacaagacgttaagcggacaatgcgcgaggtgatgaaagggaggaactggtacgcaacccctggcttctggctgcgcaccgttgggatcatcgccgtgacggccttttgcgagtggcactgggctaccacggggatggtgctgtggggcctgttgactggattcatgcacatgcagatcggcttatccatccagcatgatgcgtcccacggggccatcagcaagaagccttgggtcaacgccctcttcgcctacggcattgacgtcatcggatcgtcccggtggatttggctgcagtcgcacatcatgcggcaccacacctacaccaaccagcacggcctcgacctggatgcggagtcggcagagccgttcctggtgttccacaactaccccgccgcaaacaccgcccgaaagtggttccaccgcttccaagcttggtacatgtaccttgtgctgggggcatacggggtatcgctggtgtacaacccgctctacattttccggatgcagcacaatgacaccatcccagagtctgtcacggccatgcgggaaaatggctttctgcggcgctaccgcacacttgcattcgtgatgcgagctttcttcatcttccggaccgcattcttgccctggtacctcactgggacctcattgctgatcaccattcctctggtgcccaccgcaactggtgccttcttgacgttcttcttcattttgtcccacaattttgatggctccgaacggatccccgacaagaactgcaaggttaagagatctgagaaggacgttgaggctgaccaaattgactggtatcgggcgcaggtggagacgtcctccacatacggtggccccatcgccatgttcttcactggcggtctcaatttccagatcgagcaccacctctttccccggatgtcgtcttggcactaccccttcgtccagcaggcggtccgggagtgttgcgaacgccatggagtgcgatatgttttctaccctaccatcgtcggcaacatcatctccaccctgaagtacatgcataaggtgggtgtcgtccactgcgtgaaggacgcacaggattcctaagcggccgcaagtgtggatggggaagtgagtgcccggttctgtgtgcacaattggcaatccaagatggatggattcaacacagggatatagcgagctacgtggtggtgcgaggatatagcaacggatatttatgtttgacacttgagaatgtacgatacaagcactgtccaagtacaatactaaacatactgtacatactcatactcgtacccgggcaacggtttcacttgagtgcagtggctagtgctcttactcgtacagtgtgcaatactgcgtatcatagtctttgatgtatatcgtattcattcatgttagttgcgtacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggtaccgggccccccctcgaggtcgatggtgtcgataagcttgatatcgaattcatgtcacacaaaccgatcttcgcctcaaggaaacctaattctacatccgagagactgccgagatccagtctacactgattaattttcgggccaataatttaaaaaaatcgtgttatataatattatatgtattatatatatacatcatgatgatactgacagtcatgtcccattgctaaatagacagactccatctgccgcctccaactgatgttctcaatatttaaggggtcatctcgcattgtttaataataaacagactccatctaccgcctccaaatgatgttctcaaaatatattgtatgaacttatttttattacttagtattattagacaacttacttgctttatgaaaaacacttcctatttaggaaacaatttataatggcagttcgttcatttaacaatttatgtagaataaatgttataaatgcgtatgggaaatcttaaatatggatagcataaatgatatctgcattgcctaattcgaaatcaacagcaacgaaaaaaatcccttgtacaacataaatagtcatcgagaaatatcaactatcaaagaacagctattcacacgttactattgagattattattggacgagaatcacacactcaactgtctttctctcttctagaaatacaggtacaagtatgtactattctcattgttcatacttctagtcatttcatcccacatattccttggatttctctccaatgaatgacattctatcttgcaaattcaacaattataataagatataccaaagtagcggtatagtggcaatcaaaaagcttctctggtgtgcttctcgtatttatttttattctaatgatccattaaaggtatatatttatttcttgttatataatccttttgtttattacatgggctggatacataaaggtattttgatttaattttttgcttaaattcaatcccccctcgttcagtgtcaactgtaatggtaggaaattaccatacttttgaagaagcaaaaaaaatgaaagaaaaaaaaaatcgtatttccaggttagacgttccgcagaatctagaatgcggtatgcggtacattgttcttcgaacgtaaaagttgcgctccctgagatattgtacatttttgcttttacaagtacaagtacatcgtacaactatgtactactgttgatgcatccacaacagtttgttttgtttttttttgttttttttttttctaatgattcattaccgctatgtatacctacttgtacttgtagtaagccgggttattggcgttcaattaatcatagacttatgaatctgcacggtgtgcgctgcgagttacttttagcttatgcatgctacttgggtgtaatattgggatctgttcggaaatcaacggatgctcaatcgatttcgacagtaattaattaagtcatacacaagtcagctttcttcgagcctcatataagtataagtagttcaacgtattagcactgtacccagcatctccgtatcgagaaacacaacaacatgccccattggacagatcatgcggatacacaggttgtgcagtatcatacatactcgatcagacaggtcgtctgaccatcatacaagctgaacaagcgctccatacttgcacgctctctatatacacagttaaattacatatccatagtctaacctctaacagttaatcttctggtaagcctcccagccagccttctggtatcgcttggcctcctcaataggatctcggttctggccgtacagacctcggccgacaattatgatatccgttccggtagacatgacatcctcaacagttcggtactgctgtccgagagcgtctcccttgtcgtcaagacccaccccgggggtcagaataagccagtcctcagagtcgcccttaggtcggttctgggcaatgaagccaaccacaaactcggggtcggatcgggcaagctcaatggtctgcttggagtactcgccagtggccagagagcccttgcaagacagctcggccagcatgagcagacctctggccagcttctcgttgggagaggggactaggaactccttgtactgggagttctcgtagtcagagacgtcctccttcttctgttcagagacagtttcctcggcaccagctcgcaggccagcaatgattccggttccgggtacaccgtgggcgttggtgatatcggaccactcggcgattcggtgacaccggtactggtgcttgacagtgttgccaatatctgcgaactttctgtcctcgaacaggaagaaaccgtgcttaagagcaagttccttgagggggagcacagtgccggcgtaggtgaagtcgtcaatgatgtcgatatgggttttgatcatgcacacataaggtccgaccttatcggcaagctcaatgagctccttggtggtggtaacatccagagaagcacacaggttggttttcttggctgccacgagcttgagcactcgagcggcaaaggcggacttgtggacgttagctcgagcttcgtaggagggcattttggtggtgaagaggagactgaaataaatttagtctgcagaactttttatcggaaccttatctggggcagtgaagtatatgttatggtaatagttacgagttagttgaacttatagatagactggactatacggctatcggtccaaattagaaagaacgtcaatggctctctgggcgtcgcctttgccgacaaaaatgtgatcatgatgaaagccagcaatgacgttgcagctgatattgttgtcggccaaccgcgccgaaaacgcagctgtcagacccacagcctccaacgaagaatgtatcgtcaaagtgatccaagcacactcatagttggagtcgtactccaaaggcggcaatgacgagtcagacagatactcgtcgactcaggcgacgacggaattcctgcagcccatctgcagaattcaggagagaccgggttggcggcgtatttgtgtcccaaaaaacagccccaattgccccggagaagacggccaggccgcctagatgacaaattcaacaactcacagctgactttctgccattgccactaggggggggcctttttatatggccaagccaagctctccacgtcggttgggctgcacccaacaataaatgggtagggttgcaccaacaaagggatgggatggggggtagaagatacgaggataacggggctcaatggcacaaataagaacgaatactgccattaagactcgtgatccagcgactgacaccattgcatcatctaagggcctcaaaactacctcggaactgctgcgctgatctggacaccacagaggttccgagcactttaggttgcaccaaatgtcccaccaggtgcaggcagaaaacgctggaacagcgtgtacagtttgtcttaacaaaaagtgagggcgctgaggtcgagcagggtggtgtgacttgttatagcctttagagctgcgaaagcgcgtatggatttggctcatcaggccagattgagggtctgtggacacatgtcatgttagtgtacttcaatcgccccctggatatagccccgacaataggccgtggcctcatttttttgccttccgcacatttccattgctcggtacccacaccttgcttctcctgcacttgccaaccttaatactggtttacattgaccaacatcttacaagcggggggcttgtctagggtatatataaacagtggctctcccaatcggttgccagtctcttttttcctttctttccccacagattcgaaatctaaactacacatcacacaatgcctgttactgacgtccttaagcgaaagtccggtgtcatcgtcggcgacgatgtccgagccgtgagtatccacgacaagatcagtgtcgagacgacgcgttttgtgtaatgacacaatccgaaagtcgctagcaacacacactctctacacaaactaacccagctctc

SEQ ID NO: 195 - DNA, 1350 bp, Euglena gracilis
  CDS (1)..(1350): synthetic delta-5 desaturase (codon-optimized for Yarrowia lipolytica)
  ref <302>: TITLE: DELTA-5 DESATURASE AND ITS USE IN MAKING POLYUNSATURATED FATTY ACIDS
  ref <310>: PATENT DOCUMENT NUMBER: WO 2007/136671
  ref <311>: PATENT FILING DATE: 2007-05-16
  ref <312>: PUBLICATION DATE: 2007-11-29
  ref <313>: RELEVANT RESIDUES IN SEQ ID NO: (1)..(1350)
  ref <302>: TITLE: DELTA-5 DESATURASE AND ITS USE IN MAKING POLYUNSATURATED FATTY ACIDS
  ref <310>: PATENT DOCUMENT NUMBER: US 2007-0292924-A1
  ref <311>: PATENT FILING DATE: 2007-05-15
  ref <312>: PUBLICATION DATE: 2007-12-20
  ref <313>: RELEVANT RESIDUES IN SEQ ID NO: (1)..(1350)
atggctctctcccttactaccgagcagctgctcgagcgacccgacctggttgccatcgacggcattctctacgatctggaaggtcttgccaaggtccatcccggaggcgacttgatcctcgcttctggtgcctccgatgcttctcctctgttctactccatgcacccttacgtcaagcccgagaactcgaagctgcttcaacagttcgtgcgaggcaagcacgaccgaacctccaaggacattgtctacacctacgactctccctttgcacaggacgtcaagcgaactatgcgagaggtcatgaaaggtcggaactggtatgccacacctggattctggctgcgaaccgttggcatcattgctgtcaccgccttttgcgagtggcactgggctactaccggaatggtgctgtggggtctcttgactggattcatgcacatgcagatcggcctgtccattcagcacgatgcctctcatggtgccatcagcaaaaagccctgggtcaacgctctctttgcctacggcatcgacgtcattggatcgtccagatggatctggctgcagtctcacatcatgcgacatcacacctacaccaatcagcatggtctcgacctggatgccgagtccgcagaaccattccttgtgttccacaactaccctgctgccaacactgctcgaaagtggtttcaccgattccaggcctggtacatgtacctcgtgcttggagcctacggcgtttcgctggtgtacaaccctctctacatcttccgaatgcagcacaacgacaccattcccgagtctgtcacagccatgcgagagaacggctttctgcgacggtaccgaacccttgcattcgttatgcgagctttcttcatctttcgaaccgccttcttgccctggtatctcactggaacctccctgctcatcaccattcctctggtgcccactgctaccggtgccttcctcaccttctttttcatcttgtctcacaacttcgatggctcggagcgaatccccgacaagaactgcaaggtcaagagctccgagaaggacgttgaagccgatcagatcgactggtacagagctcaggtggagacctcttccacctacggtggacccattgccatgttctttactggcggtctcaacttccagatcgagcatcacctctttcctcgaatgtcgtcttggcactatcccttcgtgcagcaagctgtccgagagtgttgcgaacgacacggagttcggtacgtcttctaccctaccattgtgggcaacatcatttccaccctcaagtacatgcacaaagtcggtgtggttcactgtgtcaaggacgctcaggattcctaa

SEQ ID NO: 196 - protein, 449 aa, Euglena gracilis; identical to SEQ ID NO: 185

SEQ ID NO: 197 - DNA, 1350 bp, Euglena gracilis
  CDS (1)..(1350): delta-5 desaturase ("EgD5R*")
atggctctcagtcttaccacagaacagctgttagaacgccctgatttggttgcgattgatggcatcctctacgaccttgaagggcttgccaaagttcatccaggaggagatttgattctcgcttctggtgcctctgatgcctcccctctcttttattcaatgcatccatacgtcaaaccggagaactccaaattgcttcaacagttcgtccgagggaagcatgaccgcacctcgaaggacattgtctacacgtatgattctcccttcgcacaagacgttaagcggacaatgcgcgaggtgatgaaagggaggaactggtacgcaacccctggcttctggctgcgcaccgttgggatcatcgccgtgacggccttttgcgagtggcactgggctaccacggggatggtgctgtggggcctgttgactggattcatgcacatgcagatcggcttatccatccagcatgatgcgtcccacggggccatcagcaagaagccttgggtcaacgccctcttcgcctacggcattgacgtcatcggatcgtcccggtggatttggctgcagtcgcacatcatgcggcaccacacctacaccaaccagcacggcctcgacctggatgcggagtcggcagagccgttcctggtgttccacaactaccccgccgcaaacaccgcccgaaagtggttccaccgcttccaggcttggtacatgtaccttgtgctgggggcatacggggtatcgctggtgtacaacccgctctacattttccggatgcagcacaatgacaccatcccagagtctgtcacggccatgcgggaaaatggctttctgcggcgctaccgcacacttgcattcgtgatgcgagctttcttcatcttccggaccgcattcttgccctggtacctcactgggacctcattgctgatcaccattcctctggtgcccaccgcaactggtgccttcttgacgttcttcttcattttgtcccacaattttgatggctccgaacggatccccgacaagaactgcaaggttaagcgatctgagaaggacgttgaggctgaccaaattgactggtatcgggcgcaggtggagacgtcctccacatacggtggccccatcgccatgttcttcactggcggtctcaatttccagatcgagcaccacctctttccccggatgtcgtcttggcactaccccttcgtccagcaggcggtccgggagtgttgcgaacgacatggagtgcgatatgttttctaccctaccatcgtcggcaacatcatctccaccctgaagtacatgcataaggtgggtgtcgtccactgcgtgaaggacgcacaggattcctaa

SEQ ID NO: 198 - protein, 449 aa, Euglena gracilis; identical to SEQ ID NO: 193

SEQ ID NO: 199 - DNA, 8438 bp, Artificial Sequence
  Plasmid pDMW367-M4
catggctctcagtcttaccacagaacagctgttagaacgccctgatttggttgcgattgatggcatcctctacgaccttgaagggcttgccaaagttcatccaggaggagatttgattctcgcttctggtgcctctgatgcctcccctctcttttattcaatgcatccatacgtcaaaccggagaactccaaattgcttcaacagttcgtccgagggaagcatgaccgcacctcgaaggacattgtctacacgtatgattctcccttcgcacaagacgttaagcggacaatgcgcgaggtgatgaaagggaggaactggtacgcaacccctggcttctggctgcgcaccgttgggatcatcgccgtgacggccttttgcgagtggcactgggctaccacggggatggtgctgtggggcctgttgactggattcatgcacatgcagatcggcttatccatccagcatgatgcgtcccacggggccatcagcaagaagccttgggtcaacgccctcttcgcctacggcattgacgtcatcggatcgtcccggtggatttggctgcagtcgcacatcatgcggcaccacacctacaccaaccagcacggcctcgacctggatgcggagtcggcagagccgttcctggtgttccacaactaccccgccgcaaacaccgcccgaaagtggttccaccgcttccaggcttggtacatgtaccttgtgctgggggcatacggggtatcgctggtgtacaacccgctctacattttccggatgcagcacaatgacaccatcccagagtctgtcacggccatgcgggaaaatggctttctgcggcgctaccgcacacttgcattcgtgatgcgagctttcttcatcttccggaccgcattcttgccctggtacctcactgggacctcattgctgatcaccattcctctggtgcccaccgcaactggtgccttcttgacgttcttcttcattttgtcccacaattttgatggctccgaacggatccccgacaagaactgcaaggttaagcgatctgagaaggacgttgaggctgaccaaattgactggtatcgggcgcaggtggagacgtcctccacatacggtggccccatcgccatgttcttcactggcggtctcaatttccagatcgagcaccacctctttccccggatgtcgtcttggcactaccccttcgtccagcaggcggtccgggagtgttgcgaacgacatggagtgcgatatgttttctaccctaccatcgtcggcaacatcatctccaccctgaagtacatgcataaggtgggtgtcgtccactgcgtgaaggacgcacaggattcctaagcggccgcaagtgtggatggggaagtgagtgcccggttctgtgtgcacaattggcaatccaagatggatggattcaacacagggatatagcgagctacgtggtggtgcgaggatatagcaacggatatttatgtttgacacttgagaatgtacgatacaagcactgtccaagtacaatactaaacatactgtacatactcatactcgtacccgggcaacggtttcacttgagtgcagtggctagtgctcttactcgtacagtgtgcaatactgcgtatcatagtctttgatgtatatcgtattcattcatgttagttgcgtacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggtaccgggccccccctcgaggtcgatggtgtcgataagcttgatatcgaattcatgtcacacaaaccgatcttcgcctcaaggaaacctaattctacatccgagagactgccgagatccagtctacactgattaattttcgggccaataatttaaaaaaatcgtgttatataatattatatgtattatatatatacatcatgatgatactgacagtcatgtcccattgctaaatagacagactccatctgccgcctccaactgatgttctcaatatttaaggggtcatctcgcattgtttaataataaacagactccatctaccgcctccaaatgatgttctcaaaatatattgtatgaacttatttttattacttagtattattagacaacttacttgctttatgaaaaacacttcctatttaggaaacaatttataatggcagttcgttcatttaacaatttatgtagaataaatgttataaatgcgtatgggaaatcttaaatatggatagcataaatgatatctgcattgcctaattcgaaatcaacagcaacgaaaaaaatcccttgtacaacataaatagtcatcgagaaatatcaactatcaaagaacagctattcacacgttactattgagattattattggacgagaatcacacactcaactgtctttctctcttctagaaatacaggtacaagtatgtactattctcattgttcatacttctagtcatttcatcccacatattccttggatttctctccaatgaatgacattctatcttgcaaattcaacaattataataagatataccaaagtagcggtatagtggcaatcaaaaagcttctctggtgtgcttctcgtatttatttttattctaatgatccattaaaggtatatatttatttcttgttatataatccttttgtttattacatgggctggatacataaaggtattttgatttaattttttgcttaaattcaatcccccctcgttcagtgtcaactgtaatggtaggaaattaccatacttttgaagaagcaaaaaaaatgaaagaaaaaaaaaatcgtatttccaggttagacgttccgcagaatctagaatgcggtatgcggtacattgttcttcgaacgtaaaagttgcgctccctgagatattgtacatttttgcttttacaagtacaagtacatcgtacaactatgtactactgttgatgcatccacaacagtttgttttgtttttttttgttttttttttttctaatgattcattaccgctatgtatacctacttgtacttgtagtaagccgggttattggcgttcaattaatcatagacttatgaatctgcacggtgtgcgctgcgagttacttttagcttatgcatgctacttgggtgtaatattgggatctgttcggaaatcaacggatgctcaatcgatttcgacagtaattaattaagtcatacacaagtcagctttcttcgagcctcatataagtataagtagttcaacgtattagcactgtacccagcatctccgtatcgagaaacacaacaacatgccccattggacagatcatgcggatacacaggttgtgcagtatcatacatactcgatcagacaggtcgtctgaccatcatacaagctgaacaagcgctccatacttgcacgctctctatatacacagttaaattacatatccatagtctaacctctaacagttaatcttctggtaagcctcccagccagccttctggtatcgcttggcctcctcaataggatctcggttctggccgtacagacctcggccgacaattatgatatccgttccggtagacatgacatcctcaacagttcggtactgctgtccgagagcgtctcccttgtcgtcaagacccaccccgggggtcagaataagccagtcctcagagtcgcccttaggtcggttctgggcaatgaagccaaccacaaactcggggtcggatcgggcaagctcaatggtctgcttggagtactcgccagtggccagagagcccttgcaagacagctcggccagcatgagcagacctctggccagcttctcgttgggagaggggactaggaactccttgtactgggagttctcgtagtcagagacgtcctccttcttctgttcagagacagtttcctcggcaccagctcgcaggccagcaatgattccggttccgggtacaccgtgggcgttggtgatatcggaccactcggcgattcggtgacaccggtactggtgcttgacagtgttgccaatatctgcgaactttctgtcctcgaacaggaagaaaccgtgcttaagagcaagttccttgagggggagcacagtgccggcgtaggtgaagtcgtcaatgatgtcgatatgggttttgatcatgcacacataaggtccgaccttatcggcaagctcaatgagctccttggtggtggtaacatccagagaagcacacaggttggttttcttggctgccacgagcttgagcactcgagcggcaaaggcggacttgtggacgttagctcgagcttcgtaggagggcattttggtggtgaagaggagactgaaataaatttagtctgcagaactttttatcggaaccttatctggggcagtgaagtatatgttatggtaatagttacgagttagttgaacttatagatagactggactatacggctatcggtccaaattagaaagaacgtcaatggctctctgggcgtcgcctttgccgacaaaaatgtgatcatgatgaaagccagcaatgacgttgcagctgatattgttgtcggccaaccgcgccgaaaacgcagctgtcagacccacagcctccaacgaagaatgtatcgtcaaagtgatccaagcacactcatagttggagtcgtactccaaaggcggcaatgacgagtcagacagatactcgtcgactcaggcgacgacggaattcctgcagcccatctgcagaattcaggagagaccgggttggcggcgtatttgtgtcccaaaaaacagccccaattgccccggagaagacggccaggccgcctagatgacaaattcaacaactcacagctgactttctgccattgccactaggggggggcctttttatatggccaagccaagctctccacgtcggttgggctgcacccaacaataaatgggtagggttgcaccaacaaagggatgggatggggggtagaagatacgaggataacggggctcaatggcacaaataagaacgaatactgccattaagactcgtgatccagcgactgacaccattgcatcatctaagggcctcaaaactacctcggaactgctgcgctgatctggacaccacagaggttccgagcactttaggttgcaccaaatgtcccaccaggtgcaggcagaaaacgctggaacagcgtgtacagtttgtcttaacaaaaagtgagggcgctgaggtcgagcagggtggtgtgacttgttatagcctttagagctgcgaaagcgcgtatggatttggctcatcaggccagattgagggtctgtggacacatgtcatgttagtgtacttcaatcgccccctggatatagccccgacaataggccgtggcctcatttttttgccttccgcacatttccattgctcggtacccacaccttgcttctcctgcacttgccaaccttaatactggtttacattgaccaacatcttacaagcggggggcttgtctagggtatatataaacagtggctctcccaatcggttgccagtctcttttttcctttctttccccacagattcgaaatctaaactacacatcacacaatgcctgttactgacgtccttaagcgaaagtccggtgtcatcgtcggcgacgatgtccgagccgtgagtatccacgacaagatcagtgtcgagacgacgcgttttgtgtaatgacacaatccgaaagtcgctagcaacacacactctctacacaaactaacccagctctc

SEQ ID NO: 200 - DNA, 31 bp, Artificial Sequence
  Primer YL 813
cgtcaaaccggagaactccaaattgcttcaa

SEQ ID NO: 201 - DNA, 31 bp, Artificial Sequence
  Primer YL 814
ttgaagcaatttggagttctccggtttgacg

SEQ ID NO: 202 - DNA, 31 bp, Artificial Sequence
  Primer YL 815
aactgcaaggttaagcgatctgagaaggacg

SEQ ID NO: 203 - DNA, 31 bp, Artificial Sequence
  Primer YL 816
cgtccttctcagatcgcttaaccttgcagtt

SEQ ID NO: 204 - DNA, 8438 bp, Artificial Sequence
  Plasmid pDMW367-M2
catggctctcagtcttaccacagaacagctgttagaacgccctgatttggttgcgattgatggcatcctctacgaccttgaagggcttgccaaagttcatccaggaggagatttgattctcgcttctggtgcctctgatgcctcccctctcttttattcaatgcatccatacgtcaaaccggagaactccaaattgcttcaacagttcgtccgagggaagcatgaccgcacctcgaaggacattgtctacacgtatgattctcccttcgcacaagacgttaagcggacaatgcgcgaggtgatgaaagggaggaactggtacgcaacccctggcttctggctgcgcaccgttgggatcatcgccgtgacggccttttgcgagtggcactgggctaccacggggatggtgctgtggggcctgttgactggattcatgcacatgcagatcggcttatccatccagcatgatgcgtcccacggggccatcagcaagaagccttgggtcaacgccctcttcgcctacggcattgacgtcatcggatcgtcccggtggatttggctgcagtcgcacatcatgcggcaccacacctacaccaaccagcacggcctcgacctggatgcggagtcggcagagccgttcctggtgttccacaactaccccgccgcaaacaccgcccgaaagtggttccaccgcttccaagcttggtacatgtaccttgtgctgggggcatacggggtatcgctggtgtacaacccgctctacattttccggatgcagcacaatgacaccatcccagagtctgtcacggccatgcgggaaaatggctttctgcggcgctaccgcacacttgcattcgtgatgcgagctttcttcatcttccggaccgcattcttgccctggtacctcactgggacctcattgctgatcaccattcctctggtgcccaccgcaactggtgccttcttgacgttcttcttcattttgtcccacaattttgatggctccgaacggatccccgacaagaactgcaaggttaagcgatctgagaaggacgttgaggctgaccaaattgactggtatcgggcgcaggtggagacgtcctccacatacggtggccccatcgccatgttcttcactggcggtctcaatttccagatcgagcaccacctctttccccggatgtcgtcttggcactaccccttcgtccagcaggcggtccgggagtgttgcgaacgccatggagtgcgatatgttttctaccctaccatcgtcggcaacatcatctccaccctgaagtacatgcataaggtgggtgtcgtccactgcgtgaaggacgcacaggattcctaagcggccgcaagtgtggatggggaagtgagtgcccggttctgtgtgcacaattggcaatccaagatggatggattcaacacagggatatagcgagctacgtggtggtgcgaggatatagcaacggatatttatgtttgacacttgagaatgtacgatacaagcactgtccaagtacaatactaaacatactgtacatactcatactcgtacccgggcaacggtttcacttgagtgcagtggctagtgctcttactcgtacagtgtgcaatactgcgtatcatagtctttgatgtatatcgtattcattcatgttagttgcgtacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggtaccgggccccccctcgaggtcgatggtgtcgataagcttgatatcgaattcatgtcacacaaaccgatcttcgcctcaaggaaacctaattctacatccgagagactgccgagatccagtctacactgattaattttcgggccaataatttaaaaaaatcgtgttatataatattatatgtattatatatatacatcatgatgatactgacagtcatgtcccattgctaaatagacagactccatctgccgcctccaactgatgttctcaatatttaaggggtcatctcgcattgtttaataataaacagactccatctaccgcctccaaatgatgttctcaaaatatattgtatgaacttatttttattacttagtattattagacaacttacttgctttatgaaaaacacttcctatttaggaaacaatttataatggcagttcgttcatttaacaatttatgtagaataaatgttataaatgcgtatgggaaatcttaaatatggatagcataaatgatatctgcattgcctaattcgaaatcaacagcaacgaaaaaaatcccttgtacaacataaatagtcatcgagaaatatcaactatcaaagaacagctattcacacgttactattgagattattattggacgagaatcacacactcaactgtctttctctcttctagaaatacaggtacaagtatgtactattctcattgttcatacttctagtcatttcatcccacatattccttggatttctctccaatgaatgacattctatcttgcaaattcaacaattataataagatataccaaagtagcggtatagtggcaatcaaaaagcttctctggtgtgcttctcgtatttatttttattctaatgatccattaaaggtatatatttatttcttgttatataatccttttgtttattacatgggctggatacataaaggtattttgatttaattttttgcttaaattcaatcccccctcgttcagtgtcaactgtaatggtaggaaattaccatacttttgaagaagcaaaaaaaatgaaagaaaaaaaaaatcgtatttccaggttagacgttccgcagaatctagaatgcggtatgcggtacattgttcttcgaacgtaaaagttgcgctccctgagatattgtacatttttgcttttacaagtacaagtacatcgtacaactatgtactactgttgatgcatccacaacagtttgttttgtttttttttgttttttttttttctaatgattcattaccgctatgtatacctacttgtacttgtagtaagccgggttattggcgttcaattaatcatagacttatgaatctgcacggtgtgcgctgcgagttacttttagcttatgcatgctacttgggtgtaatattgggatctgttcggaaatcaacggatgctcaatcgatttcgacagtaattaattaagtcatacacaagtcagctttcttcgagcctcatataagtataagtagttcaacgtattagcactgtacccagcatctccgtatcgagaaacacaacaacatgccccattggacagatcatgcggatacacaggttgtgcagtatcatacatactcgatcagacaggtcgtctgaccatcatacaagctgaacaagcgctccatacttgcacgctctctatatacacagttaaattacatatccatagtctaacctctaacagttaatcttctggtaagcctcccagccagccttctggtatcgcttggcctcctcaataggatctcggttctggccgtacagacctcggccgacaattatgatatccgttccggtagacatgacatcctcaacagttcggtactgctgtccgagagcgtctcccttgtcgtcaagacccaccccgggggtcagaataagccagtcctcagagtcgcccttaggtcggttctgggcaatgaagccaaccacaaactcggggtcggatcgggcaagctcaatggtctgcttggagtactcgccagtggccagagagcccttgcaagacagctcggccagcatgagcagacctctggccagcttctcgttgggagaggggactaggaactccttgtactgggagttctcgtagtcagagacgtcctccttcttctgttcagagacagtttcctcggcaccagctcgcaggccagcaatgattccggttccgggtacaccgtgggcgttggtgatatcggaccactcggcgattcggtgacaccggtactggtgcttgacagtgttgccaatatctgcgaactttctgtcctcgaacaggaagaaaccgtgcttaagagcaagttccttgagggggagcacagtgccggcgtaggtgaagtcgtcaatgatgtcgatatgggttttgatcatgcacacataaggtccgaccttatcggcaagctcaatgagctccttggtggtggtaacatccagagaagcacacaggttggttttcttggctgccacgagcttgagcactcgagcggcaaaggcggacttgtggacgttagctcgagcttcgtaggagggcattttggtggtgaagaggagactgaaataaatttagtctgcagaactttttatcggaaccttatctggggcagtgaagtatatgttatggtaatagttacgagttagttgaacttatagatagactggactatacggctatcggtccaaattagaaagaacgtcaatggctctctgggcgtcgcctttgccgacaaaaatgtgatcatgatgaaagccagcaatgacgttgcagctgatattgttgtcggccaaccgcgccgaaaacgcagctgtcagacccacagcctccaacgaagaatgtatcgtcaaagtgatccaagcacactcatagttggagtcgtactccaaaggcggcaatgacgagtcagacagatactcgtcgactcaggcgacgacggaattcctgcagcccatctgcagaattcaggagagaccgggttggcggcgtatttgtgtcccaaaaaacagccccaattgccccggagaagacggccaggccgcctagatgacaaattcaacaactcacagctgactttctgccattgccactaggggggggcctttttatatggccaagccaagctctccacgtcggttgggctgcacccaacaataaatgggtagggttgcaccaacaaagggatgggatggggggtagaagatacgaggataacggggctcaatggcacaaataagaacgaatactgccattaagactcgtgatccagcgactgacaccattgcatcatctaagggcctcaaaactacctcggaactgctgcgctgatctggacaccacagaggttccgagcactttaggttgcaccaaatgtcccaccaggtgcaggcagaaaacgctggaacagcgtgtacagtttgtcttaacaaaaagtgagggcgctgaggtcgagcagggtggtgtgacttgttatagcctttagagctgcgaaagcgcgtatggatttggctcatcaggccagattgagggtctgtggacacatgtcatgttagtgtacttcaatcgccccctggatatagccccgacaataggccgtggcctcatttttttgccttccgcacatttccattgctcggtacccacaccttgcttctcctgcacttgccaaccttaatactggtttacattgaccaacatcttacaagcggggggcttgtctagggtatatataaacagtggctctcccaatcggttgccagtctcttttttcctttctttccccacagattcgaaatctaaactacacatcacacaatgcctgttactgacgtccttaagcgaaagtccggtgtcatcgtcggcgacgatgtccgagccgtgagtatccacgacaagatcagtgtcgagacgacgcgttttgtgtaatgacacaatccgaaagtcgctagcaacacacactctctacacaaactaacccagctctc

SEQ ID NO: 205 - DNA, 31 bp, Artificial Sequence
  Primer YL 829
gttccaccgcttccaggcttggtacatgtac

SEQ ID NO: 206 - DNA, 31 bp, Artificial Sequence
  Primer YL 830
gtacatgtaccaagcctggaagcggtggaac

SEQ ID NO: 207 - DNA, 32 bp, Artificial Sequence
  Primer YL 831
ggagtgttgcgaacgacatggagtgcgatatg

SEQ ID NO: 208 - DNA, 32 bp, Artificial Sequence
  Primer YL 832
catatcgcactccatgtcgttcgcaacactcc

SEQ ID NO: 209 - DNA, 39 bp, Artificial Sequence
  Primer
ttatccatccagcatgattgctcccacggggccatcagc

SEQ ID NO: 210 - DNA, 39 bp, Artificial Sequence
  Primer
gctgatggccccgtgggagcaatcatgctggatggataa

SEQ ID NO: 211 - DNA, 37 bp, Artificial Sequence
  Primer
tatccatccagcatgatgactcccacggggccatcag

SEQ ID NO: 212 - DNA, 37 bp, Artificial Sequence
  Primer
ctgatggccccgtgggagtcatcatgctggatggata

SEQ ID NO: 213 - DNA, 37 bp, Artificial Sequence
  Primer
tatccatccagcatgatgagtcccacggggccatcag

SEQ ID NO: 214 - DNA, 37 bp, Artificial Sequence
  Primer
ctgatggccccgtgggactcatcatgctggatggata

SEQ ID NO: 215 - DNA, 39 bp, Artificial Sequence
  Primer
ttatccatccagcatgatttctcccacggggccatcagc

SEQ ID NO: 216 - DNA, 39 bp, Artificial Sequence
  Primer
gctgatggccccgtgggagaaatcatgctggatggataa

SEQ ID NO: 217 - DNA, 39 bp, Artificial Sequence
  Primer
ttatccatccagcatgatggctcccacggggccatcagc

SEQ ID NO: 218 - DNA, 39 bp, Artificial Sequence
  Primer
gctgatggccccgtgggagccatcatgctggatggataa

SEQ ID NO: 219 - DNA, 37 bp, Artificial Sequence
  Primer
tatccatccagcatgatcactcccacggggccatcag

SEQ ID NO: 220 - DNA, 37 bp, Artificial Sequence
  Primer
ctgatggccccgtgggagtgatcatgctggatggata

SEQ ID NO: 221 - DNA, 37 bp, Artificial Sequence
  Primer
tatccatccagcatgatatctcccacggggccatcag

SEQ ID NO: 222 - DNA, 37 bp, Artificial Sequence
  Primer
ctgatggccccgtgggagatatcatgctggatggata

SEQ ID NO: 223 - DNA, 37 bp, Artificial Sequence
  Primer
tatccatccagcatgataagtcccacggggccatcag

SEQ ID NO: 224 - DNA, 37 bp, Artificial Sequence
  Primer
ctgatggccccgtgggacttatcatgctggatggata

SEQ ID NO: 225 - DNA, 37 bp, Artificial Sequence
  Primer
tatccatccagcatgatctgtcccacggggccatcag

SEQ ID NO: 226 - DNA, 37 bp, Artificial Sequence
  Primer
ctgatggccccgtgggacagatcatgctggatggata

SEQ ID NO: 227 - DNA, 37 bp, Artificial Sequence
  Primer
tatccatccagcatgatatgtcccacggggccatcag

SEQ ID NO: 228 - DNA, 37 bp, Artificial Sequence
  Primer
ctgatggccccgtgggacatatcatgctggatggata

SEQ ID NO: 229 - DNA, 37 bp, Artificial Sequence
  Primer
tatccatccagcatgataactcccacggggccatcag

SEQ ID NO: 230 - DNA, 37 bp, Artificial Sequence
  Primer
ctgatggccccgtgggagttatcatgctggatggata

SEQ ID NO: 231 - DNA, 37 bp, Artificial Sequence
  Primer
tatccatccagcatgatccctcccacggggccatcag

SEQ ID NO: 232 - DNA, 37 bp, Artificial Sequence
  Primer
ctgatggccccgtgggagggatcatgctggatggata

SEQ ID NO: 233 - DNA, 37 bp, Artificial Sequence
  Primer
tatccatccagcatgatcaatcccacggggccatcag

SEQ ID NO: 234 - DNA, 37 bp, Artificial Sequence
  Primer
ctgatggccccgtgggattgatcatgctggatggata

SEQ ID NO: 235 - DNA, 37 bp, Artificial Sequence
  Primer
tatccatccagcatgatcgatcccacggggccatcag

SEQ ID NO: 236 - DNA, 37 bp, Artificial Sequence
  Primer
ctgatggccccgtgggatcgatcatgctggatggata

SEQ ID NO: 237 - DNA, 39 bp, Artificial Sequence
  Primer
ttatccatccagcatgattcctcccacggggccatcagc

SEQ ID NO: 238 - DNA, 39 bp, Artificial Sequence
  Primer
gctgatggccccgtgggaggaatcatgctggatggataa

SEQ ID NO: 239 - DNA, 37 bp, Artificial Sequence
  Primer
tatccatccagcatgatacctcccacggggccatcag

SEQ ID NO: 240 - DNA, 37 bp, Artificial Sequence
  Primer
ctgatggccccgtgggaggtatcatgctggatggata

SEQ ID NO: 241 - DNA, 37 bp, Artificial Sequence
  Primer
tatccatccagcatgatgtctcccacggggccatcag

SEQ ID NO: 242 - DNA, 37 bp, Artificial Sequence
  Primer
ctgatggccccgtgggagacatcatgctggatggata

SEQ ID NO: 243 - DNA, 37 bp, Artificial Sequence
  Primer
tatccatccagcatgattggtcccacggggccatcag

SEQ ID NO: 244 - DNA, 37 bp, Artificial Sequence
  Primer
ctgatggccccgtgggaccaatcatgctggatggata

SEQ ID NO: 245 - DNA, 39 bp, Artificial Sequence
  Primer
ttatccatccagcatgattactcccacggggccatcagc

SEQ ID NO: 246 - DNA, 39 bp, Artificial Sequence
  Primer
gctgatggccccgtgggagtaatcatgctggatggataa

SEQ ID NO: 247 - protein, 449 aa, Euglena gracilis
MALSLTTEQLLERPDLVAIDGILYDLEGLAKVHPGGDLILASGASDASPLFYSMHPYVKPENSKLLQQFVRGKHDRTSKDIVYTYDSPFAQDVKRTMREVMKGRNWYATPGFWLRTVGIIAVTAFCEWHWATTGMVLWGLLTGFMHMQIGLSIQHDGSHGAISKKPWVNALFAYGIDVIGSSRWIWLQSHIMRHHTYTNQHGLDLDAESAEPFLVFHNYPAANTARKWFHRFQAWYMYLVLGAYGVSLVYNPLYIFRMQHNDTIPESVTAMRENGFLRRYRTLAFVMRAFFIFRTAFLPWYLTGTSLLITIPLVPTATGAFLTFFFILSHNFDGSERIPDKNCKVKRSEKDVEADQIDWYRAQVETSSTYGGPIAMFFTGGLNFQIEHHLFPRMSSWHYPFVQQAVRECCERHGVRYVFYPTIVGNIISTLKYMHKVGVVHCVKDAQDS

SEQ ID NO: 248 - protein, 449 aa, Euglena gracilis
MALSLTTEQLLERPDLVAIDGILYDLEGLAKVHPGGDLILASGASDASPLFYSMHPYVKPENSKLLQQFVRGKHDRTSKDIVYTYDSPFAQDVKRTMREVMKGRNWYATPGFWLRTVGIIAVTAFCEWHWATTGMVLWGLLTGFMHMQIGLSIQHDSSHGAISKKPWVNALFAYGIDVIGSSRWIWLQSHIMRHHTYTNQHGLDLDAESAEPFLVFHNYPAANTARKWFHRFQAWYMYLVLGAYGVSLVYNPLYIFRMQHNDTIPESVTAMRENGFLRRYRTLAFVMRAFFIFRTAFLPWYLTGTSLLITIPLVPTATGAFLTFFFILSHNFDGSERIPDKNCKVKRSEKDVEADQIDWYRAQVETSSTYGGPIAMFFTGGLNFQIEHHLFPRMSSWHYPFVQQAVRECCERHGVRYVFYPTIVGNIISTLKYMHKVGVVHCVKDAQDS

SEQ ID NO: 249 - DNA, 39 bp, Artificial Sequence
  Primer
tccatccagcatgatgcggctcacggggccatcagcaag

SEQ ID NO: 250 - DNA, 39 bp, Artificial Sequence
  Primer
cttgctgatggccccgtgagccgcatcatgctggatgga

SEQ ID NO: 251 - DNA, 39 bp, Artificial Sequence
  Primer
tccatccagcatgatgcgtgccacggggccatcagcaag

SEQ ID NO: 252 - DNA, 39 bp, Artificial Sequence
  Primer
cttgctgatggccccgtggcacgcatcatgctggatgga

SEQ ID NO: 253 - DNA, 39 bp, Artificial Sequence
  Primer
tccatccagcatgatgcggaccacggggccatcagcaag

SEQ ID NO: 254 - DNA, 39 bp, Artificial Sequence
  Primer
cttgctgatggccccgtggtccgcatcatgctggatgga

SEQ ID NO: 255 - DNA, 39 bp, Artificial Sequence
  Primer
tccatccagcatgatgcggagcacggggccatcagcaag

SEQ ID NO: 256 - DNA, 39 bp, Artificial Sequence
  Primer
cttgctgatggccccgtgctccgcatcatgctggatgga

SEQ ID NO: 257 - DNA, 39 bp, Artificial Sequence
  Primer
tccatccagcatgatgcgttccacggggccatcagcaag

SEQ ID NO: 258 - DNA, 39 bp, Artificial Sequence
  Primer
cttgctgatggccccgtggaacgcatcatgctggatgga

SEQ ID NO: 259 - DNA, 39 bp, Artificial Sequence
  Primer
tccatccagcatgatgcgggtcacggggccatcagcaag

SEQ ID NO: 260 - DNA, 39 bp, Artificial Sequence
  Primer
cttgctgatggccccgtgacccgcatcatgctggatgga

SEQ ID NO: 261 - DNA, 39 bp, Artificial Sequence
  Primer
tccatccagcatgatgcgcaccacggggccatcagcaag

SEQ ID NO: 262 - DNA, 39 bp, Artificial Sequence
  Primer
cttgctgatggccccgtggtgcgcatcatgctggatgga

SEQ ID NO: 263 - DNA, 39 bp, Artificial Sequence
  Primer
tccatccagcatgatgcgatccacggggccatcagcaag

SEQ ID NO: 264 - DNA, 39 bp, Artificial Sequence
  Primer
cttgctgatggccccgtggatcgcatcatgctggatgga

SEQ ID NO: 265 - DNA, 39 bp, Artificial Sequence
  Primer
tccatccagcatgatgcgaagcacggggccatcagcaag

SEQ ID NO: 266 - DNA, 39 bp, Artificial Sequence
  Primer
cttgctgatggccccgtgcttcgcatcatgctggatgga

SEQ ID NO: 267 - DNA, 39 bp, Artificial Sequence
  Primer
tccatccagcatgatgcgctgcacggggccatcagcaag

SEQ ID NO: 268 - DNA, 39 bp, Artificial Sequence
  Primer
cttgctgatggccccgtgcagcgcatcatgctggatgga

SEQ ID NO: 269 - DNA, 39 bp, Artificial Sequence
  Primer
tccatccagcatgatgcgatgcacggggccatcagcaag

SEQ ID NO: 270 - DNA, 39 bp, Artificial Sequence
  Primer
cttgctgatggccccgtgcatcgcatcatgctggatgga

SEQ ID NO: 271 - DNA, 39 bp, Artificial Sequence
  Primer
tccatccagcatgatgcgaaccacggggccatcagcaag

SEQ ID NO: 272 - DNA, 39 bp, Artificial Sequence
  Primer
cttgctgatggccccgtggttcgcatcatgctggatgga

SEQ ID NO: 273 - DNA, 39 bp, Artificial Sequence
  Primer
tccatccagcatgatgcgcctcacggggccatcagcaag

SEQ ID NO: 274 - DNA, 39 bp, Artificial Sequence
  Primer
cttgctgatggccccgtgaggcgcatcatgctggatgga

SEQ ID NO: 275 - DNA, 39 bp, Artificial Sequence
  Primer
tccatccagcatgatgcgcagcacggggccatcagcaag

SEQ ID NO: 276 - DNA, 39 bp, Artificial Sequence
  Primer
cttgctgatggccccgtgctgcgcatcatgctggatgga

SEQ ID NO: 277 - DNA, 39 bp, Artificial Sequence
  Primer
tccatccagcatgatgcgcgacacggggccatcagcaag

SEQ ID NO: 278 - DNA, 39 bp, Artificial Sequence
  Primer
cttgctgatggccccgtgtcgcgcatcatgctggatgga

SEQ ID NO: 279 - DNA, 39 bp, Artificial Sequence
  Primer
tccatccagcatgatgcgacccacggggccatcagcaag

SEQ ID NO: 280 - DNA, 39 bp, Artificial Sequence
  Primer
cttgctgatggccccgtgggtcgcatcatgctggatgga

SEQ ID NO: 281 - DNA, 39 bp, Artificial Sequence
  Primer
tccatccagcatgatgcggtccacggggccatcagcaag

SEQ ID NO: 282 - DNA, 39 bp, Artificial Sequence
  Primer
cttgctgatggccccgtggaccgcatcatgctggatgga

SEQ ID NO: 283 - DNA, 39 bp, Artificial Sequence
  Primer
tccatccagcatgatgcgtggcacggggccatcagcaag

SEQ ID NO: 284 - DNA, 39 bp, Artificial Sequence
  Primer
cttgctgatggccccgtgccacgcatcatgctggatgga

SEQ ID NO: 285 - DNA, 39 bp, Artificial Sequence
  Primer
tccatccagcatgatgcgtaccacggggccatcagcaag

SEQ ID NO: 286 - DNA, 39 bp, Artificial Sequence
  Primer
cttgctgatggccccgtggtacgcatcatgctggatgga

SEQ ID NO: 287 - protein, 449 aa, Euglena gracilis
MALSLTTEQLLERPDLVAIDGILYDLEGLAKVHPGGDLILASGASDASPLFYSMHPYVKPENSKLLQQFVRGKHDRTSKDIVYTYDSPFAQDVKRTMREVMKGRNWYATPGFWLRTVGIIAVTAFCEWHWATTGMVLWGLLTGFMHMQIGLSIQHDAAHGAISKKPWVNALFAYGIDVIGSSRWIWLQSHIMRHHTYTNQHGLDLDAESAEPFLVFHNYPAANTARKWFHRFQAWYMYLVLGAYGVSLVYNPLYIFRMQHNDTIPESVTAMRENGFLRRYRTLAFVMRAFFIFRTAFLPWYLTGTSLLITIPLVPTATGAFLTFFFILSHNFDGSERIPDKNCKVKRSEKDVEADQIDWYRAQVETSSTYGGPIAMFFTGGLNFQIEHHLFPRMSSWHYPFVQQAVRECCERHGVRYVFYPTIVGNIISTLKYMHKVGVVHCVKDAQDS

SEQ ID NO: 288 - protein, 449 aa, Euglena gracilis
MALSLTTEQLLERPDLVAIDGILYDLEGLAKVHPGGDLILASGASDASPLFYSMHPYVKPENSKLLQQFVRGKHDRTSKDIVYTYDSPFAQDVKRTMREVMKGRNWYATPGFWLRTVGIIAVTAFCEWHWATTGMVLWGLLTGFMHMQIGLSIQHDAGHGAISKKPWVNALFAYGIDVIGSSRWIWLQSHIMRHHTYTNQHGLDLDAESAEPFLVFHNYPAANTARKWFHRFQAWYMYLVLGAYGVSLVYNPLYIFRMQHNDTIPESVTAMRENGFLRRYRTLAFVMRAFFIFRTAFLPWYLTGTSLLITIPLVPTATGAFLTFFFILSHNFDGSERIPDKNCKVKRSEKDVEADQIDWYRAQVETSSTYGGPIAMFFTGGLNFQIEHHLFPRMSSWHYPFVQQAVRECCERHGVRYVFYPTIVGNIISTLKYMHKVGVVHCVKDAQDS

SEQ ID NO: 289 - DNA, 8438 bp, Artificial Sequence
  Plasmid pDMW367M4-157g
catggctctcagtcttaccacagaacagctgttagaacgccctgatttggttgcgattgatggcatcctctacgaccttgaagggcttgccaaagttcatccaggaggagatttgattctcgcttctggtgcctctgatgcctcccctctcttttattcaatgcatccatacgtcaaaccggagaactccaaattgcttcaacagttcgtccgagggaagcatgaccgcacctcgaaggacattgtctacacgtatgattctcccttcgcacaagacgttaagcggacaatgcgcgaggtgatgaaagggaggaactggtacgcaacccctggcttctggctgcgcaccgttgggatcatcgccgtgacggccttttgcgagtggcactgggctaccacggggatggtgctgtggggcctgttgactggattcatgcacatgcagatcggcttatccatccagcatgatggctcccacggggccatcagcaagaagccttgggtcaacgccctcttcgcctacggcattgacgtcatcggatcgtcccggtggatttggctgcagtcgcacatcatgcggcaccacacctacaccaaccagcacggcctcgacctggatgcggagtcggcagagccgttcctggtgttccacaactaccccgccgcaaacaccgcccgaaagtggttccaccgcttccaggcttggtacatgtaccttgtgctgggggcatacggggtatcgctggtgtacaacccgctctacattttccggatgcagcacaatgacaccatcccagagtctgtcacggccatgcgggaaaatggctttctgcggcgctaccgcacacttgcattcgtgatgcgagctttcttcatcttccggaccgcattcttgccctggtacctcactgggacctcattgctgatcaccattcctctggtgcccaccgcaactggtgccttcttgacgttcttcttcattttgtcccacaattttgatggctccgaacggatccccgacaagaactgcaaggttaagcgatctgagaaggacgttgaggctgaccaaattgactggtatcgggcgcaggtggagacgtcctccacatacggtggccccatcgccatgttcttcactggcggtctcaatttccagatcgagcaccacctctttccccggatgtcgtcttggcactaccccttcgtccagcaggcggtccgggagtgttgcgaacgacatggagtgcgatatgttttctaccctaccatcgtcggcaacatcatctccaccctgaagtacatgcataaggtgggtgtcgtccactgcgtgaaggacgcacaggattcctaagcggccgcaagtgtggatggggaagtgagtgcccggttctgtgtgcacaattggcaatccaagatggatggattcaacacagggatatagcgagctacgtggtggtgcgaggatatagcaacggatatttatgtttgacacttgagaatgtacgatacaagcactgtccaagtacaatactaaacatactgtacatactcatactcgtacccgggcaacggtttcacttgagtgcagtggctagtgctcttactcgtacagtgtgcaatactgcgtatcatagtctttgatgtatatcgtattcattcatgttagttgcgtacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggtaccgggccccccctcgaggtcgatggtgtcgataagcttgatatcgaattcatgtcacacaaaccgatcttcgcctcaaggaaacctaattctacatccgagagactgccgagatccagtctacactgattaattttcgggccaataatttaaaaaaatcgtgttatataatattatatgtattatatatatacatcatgatgatactgacagtcatgtcccattgctaaatagacagactccatctgccgcctccaactgatgttctcaatatttaaggggtcatctcgcattgtttaataataaacagactccatctaccgcctccaaatgatgttctcaaaatatattgtatgaacttatttttattacttagtattattagacaacttacttgctttatgaaaaacacttcctatttaggaaacaatttataatggcagttcgttcatttaacaatttatgtagaataaatgttataaatgcgtatgggaaatcttaaatatggatagcataaatgatatctgcattgcctaattcgaaatcaacagcaacgaaaaaaatcccttgtacaacataaatagtcatcgagaaatatcaactatcaaagaacagctattcacacgttactattgagattattattggacgagaatcacacactcaactgtctttctctcttctagaaatacaggtacaagtatgtactattctcattgttcatacttctagtcatttcatcccacatattccttggatttctctccaatgaatgacattctatcttgcaaattcaacaattataataagatataccaaagtagcggtatagtggcaatcaaaaagcttctctggtgtgcttctcgtatttatttttattctaatgatccattaaaggtatatatttatttcttgttatataatccttttgtttattacatgggctggatacataaaggtattttgatttaattttttgcttaaattcaatcccccctcgttcagtgtcaactgtaatggtaggaaattaccatacttttgaagaagcaaaaaaaatgaaagaaaaaaaaaatcgtatttccaggttagacgttccgcagaatctagaatgcggtatgcggtacattgttcttcgaacgtaaaagttgcgctccctgagatattgtacatttttgcttttacaagtacaagtacatcgtacaactatgtactactgttgatgcatccacaacagtttgttttgtttttttttgttttttttttttctaatgattcattaccgctatgtatacctacttgtacttgtagtaagccgggttattggcgttcaattaatcatagacttatgaatctgcacggtgtgcgctgcgagttacttttagcttatgcatgctacttgggtgtaatattgggatctgttcggaaatcaacggatgctcaatcgatttcgacagtaattaattaagtcatacacaagtcagctttcttcgagcctcatataagtataagtagttcaacgtattagcactgtacccagcatctccgtatcgagaaacacaacaacatgccccattggacagatcatgcggatacacaggttgtgcagtatcatacatactcgatcagacaggtcgtctgaccatcatacaagctgaacaagcgctccatacttgcacgctctctatatacacagttaaattacatatccatagtctaacctctaacagttaatcttctggtaagcctcccagccagccttctggtatcgcttggcctcctcaataggatctcggttctggccgtacagacctcggccgacaattatgatatccgttccggtagacatgacatcctcaacagttcggtactgctgtccgagagcgtctcccttgtcgtcaagacccaccccgggggtcagaataagccagtcctcagagtcgcccttaggtcggttctgggcaatgaagccaaccacaaactcggggtcggatcgggcaagctcaatggtctgcttggagtactcgccagtggccagagagcccttgcaagacagctcggccagcatgagcagacctctggccagcttctcgttgggagaggggactaggaactccttgtactgggagttctcgtagtcagagacgtcctccttcttctgttcagagacagtttcctcggcaccagctcgcaggccagcaatgattccggttccgggtacaccgtgggcgttggtgatatcggaccactcggcgattcggtgacaccggtactggtgcttgacagtgttgccaatatctgcgaactttctgtcctcgaacaggaagaaaccgtgcttaagagcaagttccttgagggggagcacagtgccggcgtaggtgaagtcgtcaatgatgtcgatatgggttttgatcatgcacacataaggtccgaccttatcggcaagctcaatgagctccttggtggtggtaacatccagagaagcacacaggttggttttcttggctgccacgagcttgagcactcgagcggcaaaggcggacttgtggacgttagctcgagcttcgtaggagggcattttggtggtgaagaggagactgaaataaatttagtctgcagaactttttatcggaaccttatctggggcagtgaagtatatgttatggtaatagttacgagttagttgaacttatagatagactggactatacggctatcggtccaaattagaaagaacgtcaatggctctctgggcgtcgcctttgccgacaaaaatgtgatcatgatgaaagccagcaatgacgttgcagctgatattgttgtcggccaaccgcgccgaaaacgcagctgtcagacccacagcctccaacgaagaatgtatcgtcaaagtgatccaagcacactcatagttggagtcgtactccaaaggcggcaatgacgagtcagacagatactcgtcgactcaggcgacgacggaattcctgcagcccatctgcagaattcaggagagaccgggttggcggcgtatttgtgtcccaaaaaacagccccaattgccccggagaagacggccaggccgcctagatgacaaattcaacaactcacagctgactttctgccattgccactaggggggggcctttttatatggccaagccaagctctccacgtcggttgggctgcacccaacaataaatgggtagggttgcaccaacaaagggatgggatggggggtagaagatacgaggataacggggctcaatggcacaaataagaacgaatactgccattaagactcgtgatccagcgactgacaccattgcatcatctaagggcctcaaaactacctcggaactgctgcgctgatctggacaccacagaggttccgagcactttaggttgcaccaaatgtcccaccaggtgcaggcagaaaacgctggaacagcgtgtacagtttgtcttaacaaaaagtgagggcgctgaggtcgagcagggtggtgtgacttgttatagcctttagagctgcgaaagcgcgtatggatttggctcatcaggccagattgagggtctgtggacacatgtcatgttagtgtacttcaatcgccccctggatatagccccgacaataggccgtggcctcatttttttgccttccgcacatttccattgctcggtacccacaccttgcttctcctgcacttgccaaccttaatactggtttacattgaccaacatcttacaagcggggggcttgtctagggtatatataaacagtggctctcccaatcggttgccagtctcttttttcctttctttccccacagattcgaaatctaaactacacatcacacaatgcctgttactgacgtccttaagcgaaagtccggtgtcatcgtcggcgacgatgtccgagccgtgagtatccacgacaagatcagtgtcgagacgacgcgttttgtgtaatgacacaatccgaaagtcgctagcaacacacactctctacacaaactaacccagctctc

SEQ ID NO: 290 - DNA, 8438 bp, Artificial Sequence
  Plasmid pDMW367M4-158a
catggctctcagtcttaccacagaacagctgttagaacgccctgatttggttgcgattgatggcatcctctacgaccttgaagggcttgccaaagttcatccaggaggagatttgattctcgcttctggtgcctctgatgcctcccctctcttttattcaatgcatccatacgtcaaaccggagaactccaaattgcttcaacagttcgtccgagggaagcatgaccgcacctcgaaggacattgtctacacgtatgattctcccttcgcacaagacgttaagcggacaatgcgcgaggtgatgaaagggaggaactggtacgcaacccctggcttctggctgcgcaccgttgggatcatcgccgtgacggccttttgcgagtggcactgggctaccacggggatggtgctgtggggcctgttgactggattcatgcacatgcagatcggcttatccatccagcatgatgcggctcacggggccatcagcaagaagccttgggtcaacgccctcttcgcctacggcattgacgtcatcggatcgtcccggtggatttggctgcagtcgcacatcatgcggcaccacacctacaccaaccagcacggcctcgacctggatgcggagtcggcagagccgttcctggtgttccacaactaccccgccgcaaacaccgcccgaaagtggttccaccgcttccaggcttggtacatgtaccttgtgctgggggcatacggggtatcgctggtgtacaacccgctctacattttccggatgcagcacaatgacaccatcccagagtctgtcacggccatgcgggaaaatggctttctgcggcgctaccgcacacttgcattcgtgatgcgagctttcttcatcttccggaccgcattcttgccctggtacctcactgggacctcattgctgatcaccattcctctggtgcccaccgcaactggtgccttcttgacgttcttcttcattttgtcccacaattttgatggctccgaacggatccccgacaagaactgcaaggttaagcgatctgagaaggacgttgaggctgaccaaattgactggtatcgggcgcaggtggagacgtcctccacatacggtggccccatcgccatgttcttcactggcggtctcaatttccagatcgagcaccacctctttccccggatgtcgtcttggcactaccccttcgtccagcaggcggtccgggagtgttgcgaacgacatggagtgcgatatgttttctaccctaccatcgtcggcaacatcatctccaccctgaagtacatgcataaggtgggtgtcgtccactgcgtgaaggacgcacaggattcctaagcggccgcaagtgtggatggggaagtgagtgcccggttctgtgtgcacaattggcaatccaagatggatggattcaacacagggatatagcgagctacgtggtggtgcgaggatatagcaacggatatttatgtttgacacttgagaatgtacgatacaagcactgtccaagtacaatactaaacatactgtacatactcatactcgtacccgggcaacggtttcacttgagtgcagtggctagtgctcttactcgtacagtgtgcaatactgcgtatcatagtctttgatgtatatcgtattcattcatgttagttgcgtacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggtaccgggccccccctcgaggtcgatggtgtcgataagcttgatatcgaattcatgtcacacaaaccgatcttcgcctcaaggaaacctaattctacatccgagagactgccgagatccagtctacactgattaattttcgggccaataatttaaaaaaatcgtgttatataatattatatgtattatatatatacatcatgatgatactgacagtcatgtcccattgctaaatagacagactccatctgccgcctccaactgatgttctcaatatttaaggggtcatctcgcattgtttaataataaacagactccatctaccgcctccaaatgatgttctcaaaatatattgtatgaacttatttttattacttagtattattagacaacttacttgctttatgaaaaacacttcctatttaggaaacaatttataatggcagttcgttcatttaacaatttatgtagaataaatgttataaatgcgtatgggaaatcttaaatatggatagcataaatgatatctgcattgcctaattcgaaatcaacagcaacgaaaaaaatcccttgtacaacataaatagtcatcgagaaatatcaactatcaaagaacagctattcacacgttactattgagattattattggacgagaatcacacactcaactgtctttctctcttctagaaatacaggtacaagtatgtactattctcattgttcatacttctagtcatttcatcccacatattccttggatttctctccaatgaatgacattctatcttgcaaattcaacaattataataagatataccaaagtagcggtatagtggcaatcaaaaagcttctctggtgtgcttctcgtatttatttttattctaatgatccattaaaggtatatatttatttcttgttatataatccttttgtttattacatgggctggatacataaaggtattttgatttaattttttgcttaaattcaatcccccctcgttcagtgtcaactgtaatggtaggaaattaccatacttttgaagaagcaaaaaaaatgaaagaaaaaaaaaatcgtatttccaggttagacgttccgcagaatctagaatgcggtatgcggtacattgttcttcgaacgtaaaagttgcgctccctgagatattgtacatttttgcttttacaagtacaagtacatcgtacaactatgtactactgttgatgcatccacaacagtttgttttgtttttttttgttttttttttttctaatgattcattaccgctatgtatacctacttgtacttgtagtaagccgggttattggcgttcaattaatcatagacttatgaatctgcacggtgtgcgctgcgagttacttttagcttatgcatgctacttgggtgtaatattgggatctgttcggaaatcaacggatgctcaatcgatttcgacagtaattaattaagtcatacacaagtcagctttcttcgagcctcatataagtataagtagttcaacgtattagcactgtacccagcatctccgtatcgagaaacacaacaacatgccccattggacagatcatgcggatacacaggttgtgcagtatcatacatactcgatcagacaggtcgtctgaccatcatacaagctgaacaagcgctccatacttgcacgctctctatatacacagttaaattacatatccatagtctaacctctaacagttaatcttctggtaagcctcccagccagccttctggtatcgcttggcctcctcaataggatctcggttctggccgtacagacctcggccgacaattatgatatccgttccggtagacatgacatcctcaacagttcggtactgctgtccgagagcgtctcccttgtcgtcaagacccaccccgggggtcagaataagccagtcctcagagtcgcccttaggtcggttctgggcaatgaagccaaccacaaactcggggtcggatcgggcaagctcaatggtctgcttggagtactcgccagtggccagagagcccttgcaagacagctcggccagcatgagcagacctctggccagcttctcgttgggagaggggactaggaactccttgtactgggagttctcgtagtcagagacgtcctccttcttctgttcagagacagtttcctcggcaccagctcgcaggccagcaatgattccggttccgggtacaccgtgggcgttggtgatatcggaccactcggcgattcggtgacaccggtactggtgcttgacagtgttgccaatatctgcgaactttctgtcctcgaacaggaagaaaccgtgcttaagagcaagttccttgagggggagcacagtgccggcgtaggtgaagtcgtcaatgatgtcgatatgggttttgatcatgcacacataaggtccgaccttatcggcaagctcaatgagctccttggtggtggtaacatccagagaagcacacaggttggttttcttggctgccacgagcttgagcactcgagcggcaaaggcggacttgtggacgttagctcgagcttcgtaggagggcattttggtggtgaagaggagactgaaataaatttagtctgcagaactttttatcggaaccttatctggggcagtgaagtatatgttatggtaatagttacgagttagttgaacttatagatagactggactatacggctatcggtccaaattagaaagaacgtcaatggctctctgggcgtcgcctttgccgacaaaaatgtgatcatgatgaaagccagcaatgacgttgcagctgatattgttgtcggccaaccgcgccgaaaacgcagctgtcagacccacagcctccaacgaagaatgtatcgtcaaagtgatccaagcacactcatagttggagtcgtactccaaaggcggcaatgacgagtcagacagatactcgtcgactcaggcgacgacggaattcctgcagcccatctgcagaattcaggagagaccgggttggcggcgtatttgtgtcccaaaaaacagccccaattgccccggagaagacggccaggccgcctagatgacaaattcaacaactcacagctgactttctgccattgccactaggggggggcctttttatatggccaagccaagctctccacgtcggttgggctgcacccaacaataaatgggtagggttgcaccaacaaagggatgggatggggggtagaagatacgaggataacggggctcaatggcacaaataagaacgaatactgccattaagactcgtgatccagcgactgacaccattgcatcatctaagggcctcaaaactacctcggaactgctgcgctgatctggacaccacagaggttccgagcactttaggttgcaccaaatgtcccaccaggtgcaggcagaaaacgctggaacagcgtgtacagtttgtcttaacaaaaagtgagggcgctgaggtcgagcagggtggtgtgacttgttatagcctttagagctgcgaaagcgcgtatggatttggctcatcaggccagattgagggtctgtggacacatgtcatgttagtgtacttcaatcgccccctggatatagccccgacaataggccgtggcctcatttttttgccttccgcacatttccattgctcggtacccacaccttgcttctcctgcacttgccaaccttaatactggtttacattgaccaacatcttacaagcggggggcttgtctagggtatatataaacagtggctctcccaatcggttgccagtctcttttttcctttctttccccacagattcgaaatctaaactacacatcacacaatgcctgttactgacgtccttaagcgaaagtccggtgtcatcgtcggcgacgatgtccgagccgtgagtatccacgacaagatcagtgtcgagacgacgcgttttgtgtaatgacacaatccgaaagtcgctagcaacacacactctctacacaaactaacccagctctc

SEQ ID NO: 291 - DNA, 8438 bp, Artificial Sequence
  Plasmid pDMW367M4-158g
catggctctcagtcttaccacagaacagctgttagaacgccctgatttggttgcgattgatggcatcctctacgaccttgaagggcttgccaaagttcatccaggaggagatttgattctcgcttctggtgcctctgatgcctcccctctcttttattcaatgcatccatacgtcaaaccggagaactccaaattgcttcaacagttcgtccgagggaagcatgaccgcacctcgaaggacattgtctacacgtatgattctcccttcgcacaagacgttaagcggacaatgcgcgaggtgatgaaagggaggaactggtacgcaacccctggcttctggctgcgcaccgttgggatcatcgccgtgacggccttttgcgagtggcactgggctaccacggggatggtgctgtggggcctgttgactggattcatgcacatgcagatcggcttatccatccagcatgatgcgggtcacggggccatcagcaagaagccttgggtcaacgccctcttcgcctacggcattgacgtcatcggatcgtcccggtggatttggctgcagtcgcacatcatgcggcaccacacctacaccaaccagcacggcctcgacctggatgcggagtcggcagagccgttcctggtgttccacaactaccccgccgcaaacaccgcccgaaagtggttccaccgcttccaggcttggtacatgtaccttgtgctgggggcatacggggtatcgctggtgtacaacccgctctacattttccggatgcagcacaatgacaccatcccagagtctgtcacggccatgcgggaaaatggctttctgcggcgctaccgcacacttgcattcgtgatgcgagctttcttcatcttccggaccgcattcttgccctggtacctcactgggacctcattgctgatcaccattcctctggtgcccaccgcaactggtgccttcttgacgttcttcttcattttgtcccacaattttgatggctccgaacggatccccgacaagaactgcaaggttaagcgatctgagaaggacgttgaggctgaccaaattgactggtatcgggcgcaggtggagacgtcctccacatacggtggccccatcgccatgttcttcactggcggtctcaatttccagatcgagcaccacctctttccccggatgtcgtcttggcactaccccttcgtccagcaggcggtccgggagtgttgcgaacgacatggagtgcgatatgttttctaccctaccatcgtcggcaacatcatctccaccctgaagtacatgcataaggtgggtgtcgtccactgcgtgaaggacgcacaggattcctaagcggccgcaagtgtggatggggaagtgagtgcccggttctgtgtgcacaattggcaatccaagatggatggattcaacacagggatatagcgagctacgtggtggtgcgaggatatagcaacggatatttatgtttgacacttgagaatgtacgatacaagcactgtccaagtacaatactaaacatactgtacatactcatactcgtacccgggcaacggtttcacttgagtgcagtggctagtgctcttactcgtacagtgtgcaatactgcgtatcatagtctttgatgtatatcgtattcattcatgttagttgcgtacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggtaccgggccccccctcgaggtcgatggtgtcgataagcttgatatcgaattcatgtcacacaaaccgatcttcgcctcaaggaaacctaattctacatccgagagactgccgagatccagtctacactgattaattttcgggccaataatttaaaaaaatcgtgttatataatattatatgtattatatatatacatcatgatgatactgacagtcatgtcccattgctaaatagacagactccatctgccgcctccaactgatgttctcaatatttaaggggtcatctcgcattgtttaataataaacagactccatctaccgcctccaaatgatgttctcaaaatatattgtatgaacttatttttattacttagtattattagacaacttacttgctttatgaaaaacacttcctatttaggaaacaatttataatggcagttcgttcatttaacaatttatgtagaataaatgttataaatgcgtatgggaaatcttaaatatggatagcataaatgatatctgcattgcctaattcgaaatcaacagcaacgaaaaaaatcccttgtacaacataaatagtcatcgagaaatatcaactatcaaagaacagctattcacacgttactattgagattattattggacgagaatcacacactcaactgtctttctctcttctagaaatacaggtacaagtatgtactattctcattgttcatacttctagtcatttcatcccacatattccttggatttctctccaatgaatgacattctatcttgcaaattcaacaattataataagatataccaaagtagcggtatagtggcaatcaaaaagcttctctggtgtgcttctcgtatttatttttattctaatgatccattaaaggtatatatttatttcttgttatataatccttttgtttattacatgggctggatacataaaggtattttgatttaattttttgcttaaattcaatcccccctcgttcagtgtcaactgtaatggtaggaaattaccatacttttgaagaagcaaaaaaaatgaaagaaaaaaaaaatcgtatttccaggttagacgttccgcagaatctagaatgcggtatgcggtacattgttcttcgaacgtaaaagttgcgctccctgagatattgtacatttttgcttttacaagtacaagtacatcgtacaactatgtactactgttgatgcatccacaacagtttgttttgtttttttttgttttttttttttctaatgattcattaccgctatgtatacctacttgtacttgtagtaagccgggttattggcgttcaattaatcatagacttatgaatctgcacggtgtgcgctgcgagttacttttagcttatgcatgctacttgggtgtaatattgggatctgttcggaaatcaacggatgctcaatcgatttcgacagtaattaattaagtcatacacaagtcagctttcttcgagcctcatataagtataagtagttcaacgtattagcactgtacccagcatctccgtatcgagaaacacaacaacatgccccattggacagatcatgcggatacacaggttgtgcagtatcatacatactcgatcagacaggtcgtctgaccatcatacaagctgaacaagcgctccatacttgcacgctctctatatacacagttaaattacatatccatagtctaacctctaacagttaatcttctggtaagcctcccagccagccttctggtatcgcttggcctcctcaataggatctcggttctggccgtacagacctcggccgacaattatgatatccgttccggtagacatgacatcctcaacagttcggtactgctgtccgagagcgtctcccttgtcgtcaagacccaccccgggggtcagaataagccagtcctcagagtcgcccttaggtcggttctgggcaatgaagccaaccacaaactcggggtcggatcgggcaagctcaatggtctgcttggagtactcgccagtggccagagagcccttgcaagacagctcggccagcatgagcagacctctggccagcttctcgttgggagaggggactaggaactccttgtactgggagttctcgtagtcagagacgtcctccttcttctgttcagagacagtttcctcggcaccagctcgcaggccagcaatgattccggttccgggtacaccgtgggcgttggtgatatcggaccactcggcgattcggtgacaccggtactggtgcttgacagtgttgccaatatctgcgaactttctgtcctcgaacaggaagaaaccgtgcttaagagcaagttccttgagggggagcacagtgccggcgtaggtgaagtcgtcaatgatgtcgatatgggttttgatcatgcacacataaggtccgaccttatcggcaagctcaatgagctccttggtggtggtaacatccagagaagcacacaggttggttttcttggctgccacgagcttgagcactcgagcggcaaaggcggacttgtggacgttagctcgagcttcgtaggagggcattttggtggtgaagaggagactgaaataaatttagtctgcagaactttttatcggaaccttatctggggcagtgaagtatatgttatggtaatagttacgagttagttgaacttatagatagactggactatacggctatcggtccaaattagaaagaacgtcaatggctctctgggcgtcgcctttgccgacaaaaatgtgatcatgatgaaagccagcaatgacgttgcagctgatattgttgtcggccaaccgcgccgaaaacgcagctgtcagacccacagcctccaacgaagaatgtatcgtcaaagtgatccaagcacactcatagttggagtcgtactccaaaggcggcaatgacgagtcagacagatactcgtcgactcaggcgacgacggaattcctgcagcccatctgcagaattcaggagagaccgggttggcggcgtatttgtgtcccaaaaaacagccccaattgccccggagaagacggccaggccgcctagatgacaaattcaacaactcacagctgactttctgccattgccactaggggggggcctttttatatggccaagccaagctctccacgtcggttgggctgcacccaacaataaatgggtagggttgcaccaacaaagggatgggatggggggtagaagatacgaggataacggggctcaatggcacaaataagaacgaatactgccattaagactcgtgatccagcgactgacaccattgcatcatctaagggcctcaaaactacctcggaactgctgcgctgatctggacaccacagaggttccgagcactttaggttgcaccaaatgtcccaccaggtgcaggcagaaaacgctggaacagcgtgtacagtttgtcttaacaaaaagtgagggcgctgaggtcgagcagggtggtgtgacttgttatagcctttagagctgcgaaagcgcgtatggatttggctcatcaggccagattgagggtctgtggacacatgtcatgttagtgtacttcaatcgccccctggatatagccccgacaataggccgtggcctcatttttttgccttccgcacatttccattgctcggtacccacaccttgcttctcctgcacttgccaaccttaatactggtttacattgaccaacatcttacaagcggggggcttgtctagggtatatataaacagtggctctcccaatcggttgccagtctcttttttcctttctttccccacagattcgaaatctaaactacacatcacacaatgcctgttactgacgtccttaagcgaaagtccggtgtcatcgtcggcgacgatgtccgagccgtgagtatccacgacaagatcagtgtcgagacgacgcgttttgtgtaatgacacaatccgaaagtcgctagcaacacacactctctacacaaactaacccagctctc

SEQ ID NO: 292 - DNA, 38 bp, Artificial Sequence
  Primer
ggcttgccaaagttcatggcggaggagatttgattctc

SEQ ID NO: 293 - DNA, 38 bp, Artificial Sequence
  Primer
gagaatcaaatctcctccgccatgaactttggcaagcc

SEQ ID NO: 294 - DNA, 38 bp, Artificial Sequence
  Primer
ggcttgccaaagttcatcacggaggagatttgattctc

SEQ ID NO: 295 - DNA, 38 bp, Artificial Sequence
  Primer
gagaatcaaatctcctccgtgatgaactttggcaagcc

SEQ ID NO: 296 - DNA, 38 bp, Artificial Sequence
  Primer
ccaaagttcatccaggatccgatttgattctcgcttct

SEQ ID NO: 297 - DNA, 38 bp, Artificial Sequence
  Primer
agaagcgagaatcaaatcggatcctggatgaactttgg

SEQ ID NO: 298 - DNA, 1350 bp, Euglena gracilis
  CDS (1)..(1350)
atggctctcagtcttaccacagaacagctgttagaacgccctgatttggttgcgattgatggcatcctctacgaccttgaagggcttgccaaagttcatggtggaggagatttgattctcgcttctggtgcctctgatgcctcccctctcttttattcaatgcatccatacgtcaaaccggagaactccaaattgcttcaacagttcgtccgagggaagcatgaccgcacctcgaaggacattgtctacacgtatgattctcccttcgcacaagacgttaagcggacaatgcgcgaggtgatgaaagggaggaactggtacgcaacccctggcttctggctgcgcaccgttgggatcatcgccgtgacggccttttgcgagtggcactgggctaccacggggatggtgctgtggggcctgttgactggattcatgcacatgcagatcggcttatccatccagcatgatggctcccacggggccatcagcaagaagccttgggtcaacgccctcttcgcctacggcattgacgtcatcggatcgtcccggtggatttggctgcagtcgcacatcatgcggcaccacacctacaccaaccagcacggcctcgacctggatgcggagtcggcagagccgttcctggtgttccacaactaccccgccgcaaacaccgcccgaaagtggttccaccgcttccaggcttggtacatgtaccttgtgctgggggcatacggggtatcgctggtgtacaacccgctctacattttccggatgcagcacaatgacaccatcccagagtctgtcacggccatgcgggaaaatggctttctgcggcgctaccgcacacttgcattcgtgatgcgagctttcttcatcttccggaccgcattcttgccctggtacctcactgggacctcattgctgatcaccattcctctggtgcccaccgcaactggtgccttcttgacgttcttcttcattttgtcccacaattttgatggctccgaacggatccccgacaagaactgcaaggttaagcgatctgagaaggacgttgaggctgaccaaattgactggtatcgggcgcaggtggagacgtcctccacatacggtggccccatcgccatgttcttcactggcggtctcaatttccagatcgagcaccacctctttccccggatgtcgtcttggcactaccccttcgtccagcaggcggtccgggagtgttgcgaacgacatggagtgcgatatgttttctaccctaccatcgtcggcaacatcatctccaccctgaagtacatgcataaggtgggtgtcgtccactgcgtgaaggacgcacaggattcctaa

SEQ ID NO: 299 - protein, 449 aa, Euglena gracilis
MALSLTTEQLLERPDLVAIDGILYDLEGLAKVHGGGDLILASGASDASPLFYSMHPYVKPENSKLLQQFVRGKHDRTSKDIVYTYDSPFAQDVKRTMREVMKGRNWYATPGFWLRTVGIIAVTAFCEWHWATTGMVLWGLLTGFMHMQIGLSIQHDGSHGAISKKPWVNALFAYGIDVIGSSRWIWLQSHIMRHHTYTNQHGLDLDAESAEPFLVFHNYPAANTARKWFHRFQAWYMYLVLGAYGVSLVYNPLYIFRMQHNDTIPESVTAMRENGFLRRYRTLAFVMRAFFIFRTAFLPWYLTGTSLLITIPLVPTATGAFLTFFFILSHNFDGSERIPDKNCKVKRSEKDVEADQIDWYRAQVETSSTYGGPIAMFFTGGLNFQIEHHLFPRMSSWHYPFVQQAVRECCERHGVRYVFYPTIVGNIISTLKYMHKVGVVHCVKDAQDS

SEQ ID NO: 300 - DNA, 1350 bp, Euglena gracilis
  CDS (1)..(1350)
atggctctcagtcttaccacagaacagctgttagaacgccctgatttggttgcgattgatggcatcctctacgaccttgaagggcttgccaaagttcatggtggaggagatttgattctcgcttctggtgcctctgatgcctcccctctcttttattcaatgcatccatacgtcaaaccggagaactccaaattgcttcaacagttcgtccgagggaagcatgaccgcacctcgaaggacattgtctacacgtatgattctcccttcgcacaagacgttaagcggacaatgcgcgaggtgatgaaagggaggaactggtacgcaacccctggcttctggctgcgcaccgttgggatcatcgccgtgacggccttttgcgagtggcactgggctaccacggggatggtgctgtggggcctgttgactggattcatgcacatgcagatcggcttatccatccagcatgatgcggctcacggggccatcagcaagaagccttgggtcaacgccctcttcgcctacggcattgacgtcatcggatcgtcccggtggatttggctgcagtcgcacatcatgcggcaccacacctacaccaaccagcacggcctcgacctggatgcggagtcggcagagccgttcctggtgttccacaactaccccgccgcaaacaccgcccgaaagtggttccaccgcttccaggcttggtacatgtaccttgtgctgggggcatacggggtatcgctggtgtacaacccgctctacattttccggatgcagcacaatgacaccatcccagagtctgtcacggccatgcgggaaaatggctttctgcggcgctaccgcacacttgcattcgtgatgcgagctttcttcatcttccggaccgcattcttgccctggtacctcactgggacctcattgctgatcaccattcctctggtgcccaccgcaactggtgccttcttgacgttcttcttcattttgtcccacaattttgatggctccgaacggatccccgacaagaactgcaaggttaagcgatctgagaaggacgttgaggctgaccaaattgactggtatcgggcgcaggtggagacgtcctccacatacggtggccccatcgccatgttcttcactggcggtctcaatttccagatcgagcaccacctctttccccggatgtcgtcttggcactaccccttcgtccagcaggcggtccgggagtgttgcgaacgacatggagtgcgatatgttttctaccctaccatcgtcggcaacatcatctccaccctgaagtacatgcataaggtgggtgtcgtccactgcgtgaaggacgcacaggattcctaa

SEQ ID NO: 301 - protein, 449 aa, Euglena gracilis
MALSLTTEQLLERPDLVAIDGILYDLEGLAKVHGGGDLILASGASDASPLFYSMHPYVKPENSKLLQQFVRGKHDRTSKDIVYTYDSPFAQDVKRTMREVMKGRNWYATPGFWLRTVGIIAVTAFCEWHWATTGMVLWGLLTGFMHMQIGLSIQHDAAHGAISKKPWVNALFAYGIDVIGSSRWIWLQSHIMRHHTYTNQHGLDLDAESAEPFLVFHNYPAANTARKWFHRFQAWYMYLVLGAYGVSLVYNPLYIFRMQHNDTIPESVTAMRENGFLRRYRTLAFVMRAFFIFRTAFLPWYLTGTSLLITIPLVPTATGAFLTFFFILSHNFDGSERIPDKNCKVKRSEKDVEADQIDWYRAQVETSSTYGGPIAMFFTGGLNFQIEHHLFPRMSSWHYPFVQQAVRECCERHGVRYVFYPTIVGNIISTLKYMHKVGVVHCVKDAQDS

SEQ ID NO: 302 - DNA, 1350 bp, Euglena gracilis
  CDS (1)..(1350)
atggctctcagtcttaccacagaacagctgttagaacgccctgatttggttgcgattgatggcatcctctacgaccttgaagggcttgccaaagttcatggtggaggagatttgattctcgcttctggtgcctctgatgcctcccctctcttttattcaatgcatccatacgtcaaaccggagaactccaaattgcttcaacagttcgtccgagggaagcatgaccgcacctcgaaggacattgtctacacgtatgattctcccttcgcacaagacgttaagcggacaatgcgcgaggtgatgaaagggaggaactggtacgcaacccctggcttctggctgcgcaccgttgggatcatcgccgtgacggccttttgcgagtggcactgggctaccacggggatggtgctgtggggcctgttgactggattcatgcacatgcagatcggcttatccatccagcatgatgcgggtcacggggccatcagcaagaagccttgggtcaacgccctcttcgcctacggcattgacgtcatcggatcgtcccggtggatttggctgcagtcgcacatcatgcggcaccacacctacaccaaccagcacggcctcgacctggatgcggagtcggcagagccgttcctggtgttccacaactaccccgccgcaaacaccgcccgaaagtggttccaccgcttccaggcttggtacatgtaccttgtgctgggggcatacggggtatcgctggtgtacaacccgctctacattttccggatgcagcacaatgacaccatcccagagtctgtcacggccatgcgggaaaatggctttctgcggcgctaccgcacacttgcattcgtgatgcgagctttcttcatcttccggaccgcattcttgccctggtacctcactgggacctcattgctgatcaccattcctctggtgcccaccgcaactggtgccttcttgacgttcttcttcattttgtcccacaattttgatggctccgaacggatccccgacaagaactgcaaggttaagcgatctgagaaggacgttgaggctgaccaaattgactggtatcgggcgcaggtggagacgtcctccacatacggtggccccatcgccatgttcttcactggcggtctcaatttccagatcgagcaccacctctttccccggatgtcgtcttggcactaccccttcgtccagcaggcggtccgggagtgttgcgaacgacatggagtgcgatatgttttctaccctaccatcgtcggcaacatcatctccaccctgaagtacatgcataaggtgggtgtcgtccactgcgtgaaggacgcacaggattcctaa

SEQ ID NO: 303 - protein, 449 aa, Euglena gracilis; identical to SEQ ID NO: 106

SEQ ID NO: 304 - DNA, 4070 bp, Artificial Sequence
  Plasmid pEgD5M
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccatggccctgtctctcactaccgaacagctcctggagcgacctgatctcgtcgctatcgatggtatcctgtacgacctcgagggcctggccaaggtgcatggtggtggagacctcattctggcctctggagcctccgacgcctctcccctcttctactctatgcatccctacgtcaagcccgagaactccaagctcctgcagcaattcgtccgagggaagcatgaccgcacctcgaaggacattgtctacacgtatgattctcccttcgcacaagacgttaagcggacaatgcgcgaggtgatgaaagggaggaactggtacgcaacccctggcttctggctgcgcaccgttgggatcatcgccgtgacggccttttgcgagtggcactgggctaccacggggatggtgctgtggggcctgttgactggattcatgcacatgcagatcggcttatccatccagcatgatgcgggtcacggggccatcagcaagaagccttgggtcaacgccctcttcgcctacggcattgacgtcatcggatcgtcccggtggatttggctgcagtcgcacatcatgcggcaccacacctacaccaaccagcacggcctcgacctggatgcggagtcggcagagccgttcctggtgttccacaactaccccgccgcaaacaccgcccgaaagtggttccaccgcttccaggcttggtacatgtaccttgtgctgggggcatacggggtatcgctggtgtacaacccgctctacattttccggatgcagcacaatgacaccatcccagagtctgtcacggccatgcgggaaaatggctttctgcggcgctaccgcacacttgcattcgtgatgcgagctttcttcatcttccggaccgcattcttgccctggtacctcactgggacctcattgctgatcaccattcctctggtgcccaccgcaactggtgccttcttgacgttcttcttcattttgtcccacaattttgatggctccgaacggatccccgacaagaactgcaaggttaagcgatctgagaaggacgttgaggctgaccaaattgactggtatcgggcgcaggtggagacgtcctccacatacggtggccccatcgccatgttcttcactggcggtctcaatttccagatcgagcaccacctctttccccggatgtcgtcttggcactaccccttcgtccagcaggcggtccgggagtgttgcgaacgacatggagtgcgatatgttttctaccctaccatcgtcggcaacatcatctccaccctgaagtacatgcataaggtgggtgtcgtccactgcgtgaaggacgcacaggattcctaagcggccgcaattcgagctcggtacctcgcgaatgcatctagatatcggatcccgggcccgtcgactgcagaggcctgcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 305 - DNA, 8438 bp, Artificial Sequence
  Plasmid pDMW367-5M
ggccgcaagtgtggatggggaagtgagtgcccggttctgtgtgcacaattggcaatccaagatggatggattcaacacagggatatagcgagctacgtggtggtgcgaggatatagcaacggatatttatgtttgacacttgagaatgtacgatacaagcactgtccaagtacaatactaaacatactgtacatactcatactcgtacccgggcaacggtttcacttgagtgcagtggctagtgctcttactcgtacagtgtgcaatactgcgtatcatagtctttgatgtatatcgtattcattcatgttagttgcgtacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggtaccgggccccccctcgaggtcgatggtgtcgataagcttgatatcgaattcatgtcacacaaaccgatcttcgcctcaaggaaacctaattctacatccgagagactgccgagatccagtctacactgattaattttcgggccaataatttaaaaaaatcgtgttatataatattatatgtattatatatatacatcatgatgatactgacagtcatgtcccattgctaaatagacagactccatctgccgcctccaactgatgttctcaatatttaaggggtcatctcgcattgtttaataataaacagactccatctaccgcctccaaatgatgttctcaaaatatattgtatgaacttatttttattacttagtattattagacaacttacttgctttatgaaaaacacttcctatttaggaaacaatttataatggcagttcgttcatttaacaatttatgtagaataaatgttataaatgcgtatgggaaatcttaaatatggatagcataaatgatatctgcattgcctaattcgaaatcaacagcaacgaaaaaaatcccttgtacaacataaatagtcatcgagaaatatcaactatcaaagaacagctattcacacgttactattgagattattattggacgagaatcacacactcaactgtctttctctcttctagaaatacaggtacaagtatgtactattctcattgttcatacttctagtcatttcatcccacatattccttggatttctctccaatgaatgacattctatcttgcaaattcaacaattataataagatataccaaagtagcggtatagtggcaatcaaaaagcttctctggtgtgcttctcgtatttatttttattctaatgatccattaaaggtatatatttatttcttgttatataatccttttgtttattacatgggctggatacataaaggtattttgatttaattttttgcttaaattcaatcccccctcgttcagtgtcaactgtaatggtaggaaattaccatacttttgaagaagcaaaaaaaatgaaagaaaaaaaaaatcgtatttccaggttagacgttccgcagaatctagaatgcggtatgcggtacattgttcttcgaacgtaaaagttgcgctccctgagatattgtacatttttgcttttacaagtacaagtacatcgtacaactatgtactactgttgatgcatccacaacagtttgttttgtttttttttgttttttttttttctaatgattcattaccgctatgtatacctacttgtacttgtagtaagccgggttattggcgttcaattaatcatagacttatgaatctgcacggtgtgcgctgcgagttacttttagcttatgcatgctacttgggtgtaatattgggatctgttcggaaatcaacggatgctcaatcgatttcgacagtaattaattaagtcatacacaagtcagctttcttcgagcctcatataagtataagtagttcaacgtattagcactgtacccagcatctccgtatcgagaaacacaacaacatgccccattggacagatcatgcggatacacaggttgtgcagtatcatacatactcgatcagacaggtcgtctgaccatcatacaagctgaacaagcgctccatacttgcacgctctctatatacacagttaaattacatatccatagtctaacctctaacagttaatcttctggtaagcctcccagccagccttctggtatcgcttggcctcctcaataggatctcggttctggccgtacagacctcggccgacaattatgatatccgttccggtagacatgacatcctcaacagttcggtactgctgtccgagagcgtctcccttgtcgtcaagacccaccccgggggtcagaataagccagtcctcagagtcgcccttaggtcggttctgggcaatgaagccaaccacaaactcggggtcggatcgggcaagctcaatggtctgcttggagtactcgccagtggccagagagcccttgcaagacagctcggccagcatgagcagacctctggccagcttctcgttgggagaggggactaggaactccttgtactgggagttctcgtagtcagagacgtcctccttcttctgttcagagacagtttcctcggcaccagctcgcaggccagcaatgattccggttccgggtacaccgtgggcgttggtgatatcggaccactcggcgattcggtgacaccggtactggtgcttgacagtgttgccaatatctgcgaactttctgtcctcgaacaggaagaaaccgtgcttaagagcaagttccttgagggggagcacagtgccggcgtaggtgaagtcgtcaatgatgtcgatatgggttttgatcatgcacacataaggtccgaccttatcggcaagctcaatgagctccttggtggtggtaacatccagagaagcacacaggttggttttcttggctgccacgagcttgagcactcgagcggcaaaggcggacttgtggacgttagctcgagcttcgtaggagggcattttggtggtgaagaggagactgaaataaatttagtctgcagaactttttatcggaaccttatctggggcagtgaagtatatgttatggtaatagttacgagttagttgaacttatagatagactggactatacggctatcggtccaaattagaaagaacgtcaatggctctctgggcgtcgcctttgccgacaaaaatgtgatcatgatgaaagccagcaatgacgttgcagctgatattgttgtcggccaaccgcgccgaaaacgcagctgtcagacccacagcctccaacgaagaatgtatcgtcaaagtgatccaagcacactcatagttggagtcgtactccaaaggcggcaatgacgagtcagacagatactcgtcgactcaggcgacgacggaattcctgcagcccatctgcagaattcaggagagaccgggttggcggcgtatttgtgtcccaaaaaacagccccaattgccccggagaagacggccaggccgcctagatgacaaattcaacaactcacagctgactttctgccattgccactaggggggggcctttttatatggccaagccaagctctccacgtcggttgggctgcacccaacaataaatgggtagggttgcaccaacaaagggatgggatggggggtagaagatacgaggataacggggctcaatggcacaaataagaacgaatactgccattaagactcgtgatccagcgactgacaccattgcatcatctaagggcctcaaaactacctcggaactgctgcgctgatctggacaccacagaggttccgagcactttaggttgcaccaaatgtcccaccaggtgcaggcagaaaacgctggaacagcgtgtacagtttgtcttaacaaaaagtgagggcgctgaggtcgagcagggtggtgtgacttgttatagcctttagagctgcgaaagcgcgtatggatttggctcatcaggccagattgagggtctgtggacacatgtcatgttagtgtacttcaatcgccccctggatatagccccgacaataggccgtggcctcatttttttgccttccgcacatttccattgctcggtacccacaccttgcttctcctgcacttgccaaccttaatactggtttacattgaccaacatcttacaagcggggggcttgtctagggtatatataaacagtggctctcccaatcggttgccagtctcttttttcctttctttccccacagattcgaaatctaaactacacatcacacaatgcctgttactgacgtccttaagcgaaagtccggtgtcatcgtcggcgacgatgtccgagccgtgagtatccacgacaagatcagtgtcgagacgacgcgttttgtgtaatgacacaatccgaaagtcgctagcaacacacactctctacacaaactaacccagctctccatggccctgtctctcactaccgaacagctcctggagcgacctgatctcgtcgctatcgatggtatcctgtacgacctcgagggcctggccaaggtgcatggtggtggagacctcattctggcctctggagcctccgacgcctctcccctcttctactctatgcatccctacgtcaagcccgagaactccaagctcctgcagcaattcgtccgagggaagcatgaccgcacctcgaaggacattgtctacacgtatgattctcccttcgcacaagacgttaagcggacaatgcgcgaggtgatgaaagggaggaactggtacgcaacccctggcttctggctgcgcaccgttgggatcatcgccgtgacggccttttgcgagtggcactgggctaccacggggatggtgctgtggggcctgttgactggattcatgcacatgcagatcggcttatccatccagcatgatgcgggtcacggggccatcagcaagaagccttgggtcaacgccctcttcgcctacggcattgacgtcatcggatcgtcccggtggatttggctgcagtcgcacatcatgcggcaccacacctacaccaaccagcacggcctcgacctggatgcggagtcggcagagccgttcctggtgttccacaactaccccgccgcaaacaccgcccgaaagtggttccaccgcttccaggcttggtacatgtaccttgtgctgggggcatacggggtatcgctggtgtacaacccgctctacattttccggatgcagcacaatgacaccatcccagagtctgtcacggccatgcgggaaaatggctttctgcggcgctaccgcacacttgcattcgtgatgcgagctttcttcatcttccggaccgcattcttgccctggtacctcactgggacctcattgctgatcaccattcctctggtgcccaccgcaactggtgccttcttgacgttcttcttcattttgtcccacaattttgatggctccgaacggatccccgacaagaactgcaaggttaagcgatctgagaaggacgttgaggctgaccaaattgactggtatcgggcgcaggtggagacgtcctccacatacggtggccccatcgccatgttcttcactggcggtctcaatttccagatcgagcaccacctctttccccggatgtcgtcttggcactaccccttcgtccagcaggcggtccgggagtgttgcgaacgacatggagtgcgatatgttttctaccctaccatcgtcggcaacatcatctccaccctgaagtacatgcataaggtgggtgtcgtccactgcgtgaaggacgcacaggattcctaagc

SEQ ID NO: 306 - DNA, 4070 bp, Artificial Sequence
  Plasmid pEgD5M1
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccatggccctgtctctcactaccgaacagctcctggagcgacctgatctcgtcgctatcgatggtatcctgtacgacctcgagggcctggccaaggtgcatggtggtggagacctcattctggcctctggagcctccgacgcctctcccctcttctactctatgcatccctacgtcaagcccgagaactccaagctcctgcagcaattcgtccgagggaagcatgaccgcacctcgaaggacattgtctacacgtatgattctcccttcgcacaagacgttaagcggacaatgcgcgaggtgatgaaagggaggaactggtacgcaacccctggcttctggctgcgcaccgttgggatcatcgccgtgacggccttttgcgagtggcactgggctaccacggggatggtgctgtggggcctgttgactggattcatgcacatgcagatcggcttatccatccagcatgatgcgggtcacggggccatcagcaagaagccttgggtcaacgccctcttcgcctacggcattgacgtcatcggatcgtcccggtggatttggctgcagtcgcacatcatgcggcaccacacctacaccaaccagcacggcctcgacctggatgcggagtcggcagagccgttcctggtgttccacaactaccccgccgcaaacaccgcccgaaagtggttccaccgcttccaggcttggtacatgtaccttgtgctgggggcatacggggtatcgctggtgtacaacccgctctacattttccggatgcagcacaatgacaccatcccagagtctgtcacggccatgcgggaaaatggctttctgcggcgctaccgcacacttgcattcgtgatgcgagctttcttcatcttccggaccgcattcttgccctggtacctcactgggacctcattgctgatcaccattcctctggtgcccaccgcaactggtgccttcttgacgttcttcttcattttgtcccacaattttgatggctccgaacggatccccgacaagaactgcaaggttaagagctctgagaaggacgttgaggctgaccaaattgactggtatcgggcgcaggtggagacgtcctccacatacggtggccccatcgccatgttcttcactggcggtctcaatttccagatcgagcaccacctctttccccggatgtcgtcttggcactaccccttcgtccagcaggcggtccgggagtgttgcgaacgacatggagtgcgatatgttttctaccctaccatcgtcggcaacatcatctccaccctgaagtacatgcataaggtgggtgtcgtccactgcgtgaaggacgcacaggattcctaagcggccgcaattcgagctcggtacctcgcgaatgcatctagatatcggatcccgggcccgtcgactgcagaggcctgcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 307 - DNA, 8438 bp, Artificial Sequence
  Plasmid pDMW367-5M1
ggccgcaagtgtggatggggaagtgagtgcccggttctgtgtgcacaattggcaatccaagatggatggattcaacacagggatatagcgagctacgtggtggtgcgaggatatagcaacggatatttatgtttgacacttgagaatgtacgatacaagcactgtccaagtacaatactaaacatactgtacatactcatactcgtacccgggcaacggtttcacttgagtgcagtggctagtgctcttactcgtacagtgtgcaatactgcgtatcatagtctttgatgtatatcgtattcattcatgttagttgcgtacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggtaccgggccccccctcgaggtcgatggtgtcgataagcttgatatcgaattcatgtcacacaaaccgatcttcgcctcaaggaaacctaattctacatccgagagactgccgagatccagtctacactgattaattttcgggccaataatttaaaaaaatcgtgttatataatattatatgtattatatatatacatcatgatgatactgacagtcatgtcccattgctaaatagacagactccatctgccgcctccaactgatgttctcaatatttaaggggtcatctcgcattgtttaataataaacagactccatctaccgcctccaaatgatgttctcaaaatatattgtatgaacttatttttattacttagtattattagacaacttacttgctttatgaaaaacacttcctatttaggaaacaatttataatggcagttcgttcatttaacaatttatgtagaataaatgttataaatgcgtatgggaaatcttaaatatggatagcataaatgatatctgcattgcctaattcgaaatcaacagcaacgaaaaaaatcccttgtacaacataaatagtcatcgagaaatatcaactatcaaagaacagctattcacacgttactattgagattattattggacgagaatcacacactcaactgtctttctctcttctagaaatacaggtacaagtatgtactattctcattgttcatacttctagtcatttcatcccacatattccttggatttctctccaatgaatgacattctatcttgcaaattcaacaattataataagatataccaaagtagcggtatagtggcaatcaaaaagcttctctggtgtgcttctcgtatttatttttattctaatgatccattaaaggtatatatttatttcttgttatataatccttttgtttattacatgggctggatacataaaggtattttgatttaattttttgcttaaattcaatcccccctcgttcagtgtcaactgtaatggtaggaaattaccatacttttgaagaagcaaaaaaaatgaaagaaaaaaaaaatcgtatttccaggttagacgttccgcagaatctagaatgcggtatgcggtacattgttcttcgaacgtaaaagttgcgctccctgagatattgtacatttttgcttttacaagtacaagtacatcgtacaactatgtactactgttgatgcatccacaacagtttgttttgtttttttttgttttttttttttctaatgattcattaccgctatgtatacctacttgtacttgtagtaagccgggttattggcgttcaattaatcatagacttatgaatctgcacggtgtgcgctgcgagttacttttagcttatgcatgctacttgggtgtaatattgggatctgttcggaaatcaacggatgctcaatcgatttcgacagtaattaattaagtcatacacaagtcagctttcttcgagcctcatataagtataagtagttcaacgtattagcactgtacccagcatctccgtatcgagaaacacaacaacatgccccattggacagatcatgcggatacacaggttgtgcagtatcatacatactcgatcagacaggtcgtctgaccatcatacaagctgaacaagcgctccatacttgcacgctctctatatacacagttaaattacatatccatagtctaacctctaacagttaatcttctggtaagcctcccagccagccttctggtatcgcttggcctcctcaataggatctcggttctggccgtacagacctcggccgacaattatgatatccgttccggtagacatgacatcctcaacagttcggtactgctgtccgagagcgtctcccttgtcgtcaagacccaccccgggggtcagaataagccagtcctcagagtcgcccttaggtcggttctgggcaatgaagccaaccacaaactcggggtcggatcgggcaagctcaatggtctgcttggagtactcgccagtggccagagagcccttgcaagacagctcggccagcatgagcagacctctggccagcttctcgttgggagaggggactaggaactccttgtactgggagttctcgtagtcagagacgtcctccttcttctgttcagagacagtttcctcggcaccagctcgcaggccagcaatgattccggttccgggtacaccgtgggcgttggtgatatcggaccactcggcgattcggtgacaccggtactggtgcttgacagtgttgccaatatctgcgaactttctgtcctcgaacaggaagaaaccgtgcttaagagcaagttccttgagggggagcacagtgccggcgtaggtgaagtcgtcaatgatgtcgatatgggttttgatcatgcacacataaggtccgaccttatcggcaagctcaatgagctccttggtggtggtaacatccagagaagcacacaggttggttttcttggctgccacgagcttgagcactcgagcggcaaaggcggacttgtggacgttagctcgagcttcgtaggagggcattttggtggtgaagaggagactgaaataaatttagtctgcagaactttttatcggaaccttatctggggcagtgaagtatatgttatggtaatagttacgagttagttgaacttatagatagactggactatacggctatcggtccaaattagaaagaacgtcaatggctctctgggcgtcgcctttgccgacaaaaatgtgatcatgatgaaagccagcaatgacgttgcagctgatattgttgtcggccaaccgcgccgaaaacgcagctgtcagacccacagcctccaacgaagaatgtatcgtcaaagtgatccaagcacactcatagttggagtcgtactccaaaggcggcaatgacgagtcagacagatactcgtcgactcaggcgacgacggaattcctgcagcccatctgcagaattcaggagagaccgggttggcggcgtatttgtgtcccaaaaaacagccccaattgccccggagaagacggccaggccgcctagatgacaaattcaacaactcacagctgactttctgccattgccactaggggggggcctttttatatggccaagccaagctctccacgtcggttgggctgcacccaacaataaatgggtagggttgcaccaacaaagggatgggatggggggtagaagatacgaggataacggggctcaatggcacaaataagaacgaatactgccattaagactcgtgatccagcgactgacaccattgcatcatctaagggcctcaaaactacctcggaactgctgcgctgatctggacaccacagaggttccgagcactttaggttgcaccaaatgtcccaccaggtgcaggcagaaaacgctggaacagcgtgtacagtttgtcttaacaaaaagtgagggcgctgaggtcgagcagggtggtgtgacttgttatagcctttagagctgcgaaagcgcgtatggatttggctcatcaggccagattgagggtctgtggacacatgtcatgttagtgtacttcaatcgccccctggatatagccccgacaataggccgtggcctcatttttttgccttccgcacatttccattgctcggtacccacaccttgcttctcctgcacttgccaaccttaatactggtttacattgaccaacatcttacaagcggggggcttgtctagggtatatataaacagtggctctcccaatcggttgccagtctcttttttcctttctttccccacagattcgaaatctaaactacacatcacacaatgcctgttactgacgtccttaagcgaaagtccggtgtcatcgtcggcgacgatgtccgagccgtgagtatccacgacaagatcagtgtcgagacgacgcgttttgtgtaatgacacaatccgaaagtcgctagcaacacacactctctacacaaactaacccagctctccatggccctgtctctcactaccgaacagctcctggagcgacctgatctcgtcgctatcgatggtatcctgtacgacctcgagggcctggccaaggtgcatggtggtggagacctcattctggcctctggagcctccgacgcctctcccctcttctactctatgcatccctacgtcaagcccgagaactccaagctcctgcagcaattcgtccgagggaagcatgaccgcacctcgaaggacattgtctacacgtatgattctcccttcgcacaagacgttaagcggacaatgcgcgaggtgatgaaagggaggaactggtacgcaacccctggcttctggctgcgcaccgttgggatcatcgccgtgacggccttttgcgagtggcactgggctaccacggggatggtgctgtggggcctgttgactggattcatgcacatgcagatcggcttatccatccagcatgatgcgggtcacggggccatcagcaagaagccttgggtcaacgccctcttcgcctacggcattgacgtcatcggatcgtcccggtggatttggctgcagtcgcacatcatgcggcaccacacctacaccaaccagcacggcctcgacctggatgcggagtcggcagagccgttcctggtgttccacaactaccccgccgcaaacaccgcccgaaagtggttccaccgcttccaggcttggtacatgtaccttgtgctgggggcatacggggtatcgctggtgtacaacccgctctacattttccggatgcagcacaatgacaccatcccagagtctgtcacggccatgcgggaaaatggctttctgcggcgctaccgcacacttgcattcgtgatgcgagctttcttcatcttccggaccgcattcttgccctggtacctcactgggacctcattgctgatcaccattcctctggtgcccaccgcaactggtgccttcttgacgttcttcttcattttgtcccacaattttgatggctccgaacggatccccgacaagaactgcaaggttaagagctctgagaaggacgttgaggctgaccaaattgactggtatcgggcgcaggtggagacgtcctccacatacggtggccccatcgccatgttcttcactggcggtctcaatttccagatcgagcaccacctctttccccggatgtcgtcttggcactaccccttcgtccagcaggcggtccgggagtgttgcgaacgacatggagtgcgatatgttttctaccctaccatcgtcggcaacatcatctccaccctgaagtacatgcataaggtgggtgtcgtccactgcgtgaaggacgcacaggattcctaagc

SEQ ID NO: 308 - protein, 449 aa, Euglena gracilis
MALSLTTEQLLERPDLVAIDGILYDLEGLAKVHPGSDLILASGASDASPLFYSMHPYVKPENSKLLQQFVRGKHDRTSKDIVYTYDSPFAQDVKRTMREVMKGRNWYATPGFWLRTVGIIAVTAFCEWHWATTGMVLWGLLTGFMHMQIGLSIQHDASHGAISKKPWVNALFAYGIDVIGSSRWIWLQSHIMRHHTYTNQHGLDLDAESAEPFLVFHNYPAANTARKWFHRFQAWYMYLVLGAYGVSLVYNPLYIFRMQHNDTIPESVTAMRENGFLRRYRTLAFVMRAFFIFRTAFLPWYLTGTSLLITIPLVPTATGAFLTFFFILSHNFDGSERIPDKNCKVKSSEKDVEADQIDWYRAQVETSSTYGGPIAMFFTGGLNFQIEHHLFPRMSSWHYPFVQQAVRECCERHGVRYVFYPTIVGNIISTLKYMHKVGVVHCVKDAQDS

SEQ ID NO: 309 - DNA, 8438 bp, Artificial Sequence
  Plasmid pDMW369S
ggccgcaagtgtggatggggaagtgagtgcccggttctgtgtgcacaattggcaatccaagatggatggattcaacacagggatatagcgagctacgtggtggtgcgaggatatagcaacggatatttatgtttgacacttgagaatgtacgatacaagcactgtccaagtacaatactaaacatactgtacatactcatactcgtacccgggcaacggtttcacttgagtgcagtggctagtgctcttactcgtacagtgtgcaatactgcgtatcatagtctttgatgtatatcgtattcattcatgttagttgcgtacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggtaccgggccccccctcgaggtcgatggtgtcgataagcttgatatcgaattcatgtcacacaaaccgatcttcgcctcaaggaaacctaattctacatccgagagactgccgagatccagtctacactgattaattttcgggccaataatttaaaaaaatcgtgttatataatattatatgtattatatatatacatcatgatgatactgacagtcatgtcccattgctaaatagacagactccatctgccgcctccaactgatgttctcaatatttaaggggtcatctcgcattgtttaataataaacagactccatctaccgcctccaaatgatgttctcaaaatatattgtatgaacttatttttattacttagtattattagacaacttacttgctttatgaaaaacacttcctatttaggaaacaatttataatggcagttcgttcatttaacaatttatgtagaataaatgttataaatgcgtatgggaaatcttaaatatggatagcataaatgatatctgcattgcctaattcgaaatcaacagcaacgaaaaaaatcccttgtacaacataaatagtcatcgagaaatatcaactatcaaagaacagctattcacacgttactattgagattattattggacgagaatcacacactcaactgtctttctctcttctagaaatacaggtacaagtatgtactattctcattgttcatacttctagtcatttcatcccacatattccttggatttctctccaatgaatgacattctatcttgcaaattcaacaattataataagatataccaaagtagcggtatagtggcaatcaaaaagcttctctggtgtgcttctcgtatttatttttattctaatgatccattaaaggtatatatttatttcttgttatataatccttttgtttattacatgggctggatacataaaggtattttgatttaattttttgcttaaattcaatcccccctcgttcagtgtcaactgtaatggtaggaaattaccatacttttgaagaagcaaaaaaaatgaaagaaaaaaaaaatcgtatttccaggttagacgttccgcagaatctagaatgcggtatgcggtacattgttcttcgaacgtaaaagttgcgctccctgagatattgtacatttttgcttttacaagtacaagtacatcgtacaactatgtactactgttgatgcatccacaacagtttgttttgtttttttttgttttttttttttctaatgattcattaccgctatgtatacctacttgtacttgtagtaagccgggttattggcgttcaattaatcatagacttatgaatctgcacggtgtgcgctgcgagttacttttagcttatgcatgctacttgggtgtaatattgggatctgttcggaaatcaacggatgctcaatcgatttcgacagtaattaattaagtcatacacaagtcagctttcttcgagcctcatataagtataagtagttcaacgtattagcactgtacccagcatctccgtatcgagaaacacaacaacatgccccattggacagatcatgcggatacacaggttgtgcagtatcatacatactcgatcagacaggtcgtctgaccatcatacaagctgaacaagcgctccatacttgcacgctctctatatacacagttaaattacatatccatagtctaacctctaacagttaatcttctggtaagcctcccagccagccttctggtatcgcttggcctcctcaataggatctcggttctggccgtacagacctcggccgacaattatgatatccgttccggtagacatgacatcctcaacagttcggtactgctgtccgagagcgtctcccttgtcgtcaagacccaccccgggggtcagaataagccagtcctcagagtcgcccttaggtcggttctgggcaatgaagccaaccacaaactcggggtcggatcgggcaagctcaatggtctgcttggagtactcgccagtggccagagagcccttgcaagacagctcggccagcatgagcagacctctggccagcttctcgttgggagaggggactaggaactccttgtactgggagttctcgtagtcagagacgtcctccttcttctgttcagagacagtttcctcggcaccagctcgcaggccagcaatgattccggttccgggtacaccgtgggcgttggtgatatcggaccactcggcgattcggtgacaccggtactggtgcttgacagtgttgccaatatctgcgaactttctgtcctcgaacaggaagaaaccgtgcttaagagcaagttccttgagggggagcacagtgccggcgtaggtgaagtcgtcaatgatgtcgatatgggttttgatcatgcacacataaggtccgaccttatcggcaagctcaatgagctccttggtggtggtaacatccagagaagcacacaggttggttttcttggctgccacgagcttgagcactcgagcggcaaaggcggacttgtggacgttagctcgagcttcgtaggagggcattttggtggtgaagaggagactgaaataaatttagtctgcagaactttttatcggaaccttatctggggcagtgaagtatatgttatggtaatagttacgagttagttgaacttatagatagactggactatacggctatcggtccaaattagaaagaacgtcaatggctctctgggcgtcgcctttgccgacaaaaatgtgatcatgatgaaagccagcaatgacgttgcagctgatattgttgtcggccaaccgcgccgaaaacgcagctgtcagacccacagcctccaacgaagaatgtatcgtcaaagtgatccaagcacactcatagttggagtcgtactccaaaggcggcaatgacgagtcagacagatactcgtcgactcaggcgacgacggaattcctgcagcccatctgcagaattcaggagagaccgggttggcggcgtatttgtgtcccaaaaaacagccccaattgccccggagaagacggccaggccgcctagatgacaaattcaacaactcacagctgactttctgccattgccactaggggggggcctttttatatggccaagccaagctctccacgtcggttgggctgcacccaacaataaatgggtagggttgcaccaacaaagggatgggatggggggtagaagatacgaggataacggggctcaatggcacaaataagaacgaatactgccattaagactcgtgatccagcgactgacaccattgcatcatctaagggcctcaaaactacctcggaactgctgcgctgatctggacaccacagaggttccgagcactttaggttgcaccaaatgtcccaccaggtgcaggcagaaaacgctggaacagcgtgtacagtttgtcttaacaaaaagtgagggcgctgaggtcgagcagggtggtgtgacttgttatagcctttagagctgcgaaagcgcgtatggatttggctcatcaggccagattgagggtctgtggacacatgtcatgttagtgtacttcaatcgccccctggatatagccccgacaataggccgtggcctcatttttttgccttccgcacatttccattgctcggtacccacaccttgcttctcctgcacttgccaaccttaatactggtttacattgaccaacatcttacaagcggggggcttgtctagggtatatataaacagtggctctcccaatcggttgccagtctcttttttcctttctttccccacagattcgaaatctaaactacacatcacacaatgcctgttactgacgtccttaagcgaaagtccggtgtcatcgtcggcgacgatgtccgagccgtgagtatccacgacaagatcagtgtcgagacgacgcgttttgtgtaatgacacaatccgaaagtcgctagcaacacacactctctacacaaactaacccagctctccatggctctctcccttactaccgagcagctgctcgagcgacccgacctggttgccatcgacggcattctctacgatctggaaggtcttgccaaggtccatcccggatccgacttgatcctcgcttctggtgcctccgatgcttctcctctgttctactccatgcacccttacgtcaagcccgagaactcgaagctgcttcaacagttcgtgcgaggcaagcacgaccgaacctccaaggacattgtctacacctacgactctccctttgcacaggacgtcaagcgaactatgcgagaggtcatgaaaggtcggaactggtatgccacacctggattctggctgcgaaccgttggcatcattgctgtcaccgccttttgcgagtggcactgggctactaccggaatggtgctgtggggtctcttgactggattcatgcacatgcagatcggcctgtccattcagcacgatgcctctcatggtgccatcagcaaaaagccctgggtcaacgctctctttgcctacggcatcgacgtcattggatcgtccagatggatctggctgcagtctcacatcatgcgacatcacacctacaccaatcagcatggtctcgacctggatgccgagtccgcagaaccattccttgtgttccacaactaccctgctgccaacactgctcgaaagtggtttcaccgattccaggcctggtacatgtacctcgtgcttggagcctacggcgtttcgctggtgtacaaccctctctacatcttccgaatgcagcacaacgacaccattcccgagtctgtcacagccatgcgagagaacggctttctgcgacggtaccgaacccttgcattcgttatgcgagctttcttcatctttcgaaccgccttcttgccctggtatctcactggaacctccctgctcatcaccattcctctggtgcccactgctaccggtgccttcctcaccttctttttcatcttgtctcacaacttcgatggctcggagcgaatccccgacaagaactgcaaggtcaagagctccgagaaggacgttgaagccgatcagatcgactggtacagagctcaggtggagacctcttccacctacggtggacccattgccatgttctttactggcggtctcaacttccagatcgagcatcacctctttcctcgaatgtcgtcttggcactatcccttcgtgcagcaagctgtccgagagtgttgcgaacgacacggagttcggtacgtcttctaccctaccattgtgggcaacatcatttccaccctcaagtacatgcacaaagtcggtgtggttcactgtgtcaaggacgctcaggattcctaagc

SEQ ID NO: 310 - DNA, 39 bp, Artificial Sequence
  Primer
cctgtccattcagcacgatttctctcatggtgccatcag

SEQ ID NO: 311 - DNA, 39 bp, Artificial Sequence
  Primer
ctgatggcaccatgagagaaatcgtgctgaatggacagg

SEQ ID NO: 312 - DNA, 39 bp, Artificial Sequence
  Primer
cctgtccattcagcacgatatgtctcatggtgccatcag

SEQ ID NO: 313 - DNA, 39 bp, Artificial Sequence
  Primer
ctgatggcaccatgagacatatcgtgctgaatggacagg

SEQ ID NO: 314 - DNA, 36 bp, Artificial Sequence
  Primer
gtccattcagcacgatggttctcatggtgccatcag

SEQ ID NO: 315 - DNA, 36 bp, Artificial Sequence
  Primer
ctgatggcaccatgagaaccatcgtgctgaatggac

SEQ ID NO: 316 - DNA, 31 bp, Artificial Sequence
  Primer
gtccattcagcacgattcctctcatggtgcc

SEQ ID NO: 317 - DNA, 31 bp, Artificial Sequence
  Primer
ggcaccatgagaggaatcgtgctgaatggac

SEQ ID NO: 318 - DNA, 33 bp, Artificial Sequence
  Primer
cattcagcacgatgccgctcatggtgccatcag

SEQ ID NO: 319 - DNA, 33 bp, Artificial Sequence
  Primer
ctgatggcaccatgagcggcatcgtgctgaatg

SEQ ID NO: 320 - DNA, 45 bp, Artificial Sequence
  Primer
ctgtccattcagcacgatgccaaccatggtgccatcagcaaaaag

SEQ ID NO: 321 - DNA, 45 bp, Artificial Sequence
  Primer
ctttttgctgatggcaccatggttggcatcgtgctgaatggacag

SEQ ID NO: 322 - DNA, 35 bp, Artificial Sequence
  Primer
cattcagcacgatgccacccatggtgccatcagca

SEQ ID NO: 323 - DNA, 35 bp, Artificial Sequence
  Primer
tgctgatggcaccatgggtggcatcgtgctgaatg

SEQ ID NO: 324 - DNA, 34 bp, Artificial Sequence
  Primer
cattcagcacgatgccggtcatggtgccatcagc

SEQ ID NO: 325 - DNA, 34 bp, Artificial Sequence
  Primer
gctgatggcaccatgaccggcatcgtgctgaatg

SEQ ID NO: 326 - DNA, 31 bp, Artificial Sequence
  Primer
ctgtccattcagcacgaggcctctcatggtg

SEQ ID NO: 327 - DNA, 31 bp, Artificial Sequence
  Primer
caccatgagaggcctcgtgctgaatggacag

SEQ ID NO: 328 - DNA, 1350 bp, Euglena gracilis
  CDS (1)..(1350)
atggctctctcccttactaccgagcagctgctcgagcgacccgacctggttgccatcgacggcattctctacgatctggaaggtcttgccaaggtccatcccggatccgacttgatcctcgcttctggtgcctccgatgcttctcctctgttctactccatgcacccttacgtcaagcccgagaactcgaagctgcttcaacagttcgtgcgaggcaagcacgaccgaacctccaaggacattgtctacacctacgactctccctttgcacaggacgtcaagcgaactatgcgagaggtcatgaaaggtcggaactggtatgccacacctggattctggctgcgaaccgttggcatcattgctgtcaccgccttttgcgagtggcactgggctactaccggaatggtgctgtggggtctcttgactggattcatgcacatgcagatcggcctgtccattcagcacgaggcctctcatggtgccatcagcaaaaagccctgggtcaacgctctctttgcctacggcatcgacgtcattggatcgtccagatggatctggctgcagtctcacatcatgcgacatcacacctacaccaatcagcatggtctcgacctggatgccgagtccgcagaaccattccttgtgttccacaactaccctgctgccaacactgctcgaaagtggtttcaccgattccaggcctggtacatgtacctcgtgcttggagcctacggcgtttcgctggtgtacaaccctctctacatcttccgaatgcagcacaacgacaccattcccgagtctgtcacagccatgcgagagaacggctttctgcgacggtaccgaacccttgcattcgttatgcgagctttcttcatctttcgaaccgccttcttgccctggtatctcactggaacctccctgctcatcaccattcctctggtgcccactgctaccggtgccttcctcaccttctttttcatcttgtctcacaacttcgatggctcggagcgaatccccgacaagaactgcaaggtcaagagctccgagaaggacgttgaagccgatcagatcgactggtacagagctcaggtggagacctcttccacctacggtggacccattgccatgttctttactggcggtctcaacttccagatcgagcatcacctctttcctcgaatgtcgtcttggcactatcccttcgtgcagcaagctgtccgagagtgttgcgaacgacacggagttcggtacgtcttctaccctaccattgtgggcaacatcatttccaccctcaagtacatgcacaaagtcggtgtggttcactgtgtcaaggacgctcaggattcctaa

SEQ ID NO: 329 - protein, 449 aa, Euglena gracilis
MALSLTTEQLLERPDLVAIDGILYDLEGLAKVHPGSDLILASGASDASPLFYSMHPYVKPENSKLLQQFVRGKHDRTSKDIVYTYDSPFAQDVKRTMREVMKGRNWYATPGFWLRTVGIIAVTAFCEWHWATTGMVLWGLLTGFMHMQIGLSIQHEASHGAISKKPWVNALFAYGIDVIGSSRWIWLQSHIMRHHTYTNQHGLDLDAESAEPFLVFHNYPAANTARKWFHRFQAWYMYLVLGAYGVSLVYNPLYIFRMQHNDTIPESVTAMRENGFLRRYRTLAFVMRAFFIFRTAFLPWYLTGTSLLITIPLVPTATGAFLTFFFILSHNFDGSERIPDKNCKVKSSEKDVEADQIDWYRAQVETSSTYGGPIAMFFTGGLNFQIEHHLFPRMSSWHYPFVQQAVRECCERHGVRYVFYPTIVGNIISTLKYMHKVGVVHCVKDAQDS

SEQ ID NO: 330 - DNA, 1350 bp, Euglena gracilis
  CDS (1)..(1350)
atggctctctcccttactaccgagcagctgctcgagcgacccgacctggttgccatcgacggcattctctacgatctggaaggtcttgccaaggtccatcccggatccgacttgatcctcgcttctggtgcctccgatgcttctcctctgttctactccatgcacccttacgtcaagcccgagaactcgaagctgcttcaacagttcgtgcgaggcaagcacgaccgaacctccaaggacattgtctacacctacgactctccctttgcacaggacgtcaagcgaactatgcgagaggtcatgaaaggtcggaactggtatgccacacctggattctggctgcgaaccgttggcatcattgctgtcaccgccttttgcgagtggcactgggctactaccggaatggtgctgtggggtctcttgactggattcatgcacatgcagatcggcctgtccattcagcacgatgccgctcatggtgccatcagcaaaaagccctgggtcaacgctctctttgcctacggcatcgacgtcattggatcgtccagatggatctggctgcagtctcacatcatgcgacatcacacctacaccaatcagcatggtctcgacctggatgccgagtccgcagaaccattccttgtgttccacaactaccctgctgccaacactgctcgaaagtggtttcaccgattccaggcctggtacatgtacctcgtgcttggagcctacggcgtttcgctggtgtacaaccctctctacatcttccgaatgcagcacaacgacaccattcccgagtctgtcacagccatgcgagagaacggctttctgcgacggtaccgaacccttgcattcgttatgcgagctttcttcatctttcgaaccgccttcttgccctggtatctcactggaacctccctgctcatcaccattcctctggtgcccactgctaccggtgccttcctcaccttctttttcatcttgtctcacaacttcgatggctcggagcgaatccccgacaagaactgcaaggtcaagagctccgagaaggacgttgaagccgatcagatcgactggtacagagctcaggtggagacctcttccacctacggtggacccattgccatgttctttactggcggtctcaacttccagatcgagcatcacctctttcctcgaatgtcgtcttggcactatcccttcgtgcagcaagctgtccgagagtgttgcgaacgacacggagttcggtacgtcttctaccctaccattgtgggcaacatcatttccaccctcaagtacatgcacaaagtcggtgtggttcactgtgtcaaggacgctcaggattcctaa

SEQ ID NO: 331 - protein, 449 aa, Euglena gracilis
MALSLTTEQLLERPDLVAIDGILYDLEGLAKVHPGSDLILASGASDASPLFYSMHPYVKPENSKLLQQFVRGKHDRTSKDIVYTYDSPFAQDVKRTMREVMKGRNWYATPGFWLRTVGIIAVTAFCEWHWATTGMVLWGLLTGFMHMQIGLSIQHDAAHGAISKKPWVNALFAYGIDVIGSSRWIWLQSHIMRHHTYTNQHGLDLDAESAEPFLVFHNYPAANTARKWFHRFQAWYMYLVLGAYGVSLVYNPLYIFRMQHNDTIPESVTAMRENGFLRRYRTLAFVMRAFFIFRTAFLPWYLTGTSLLITIPLVPTATGAFLTFFFILSHNFDGSERIPDKNCKVKSSEKDVEADQIDWYRAQVETSSTYGGPIAMFFTGGLNFQIEHHLFPRMSSWHYPFVQQAVRECCERHGVRYVFYPTIVGNIISTLKYMHKVGVVHCVKDAQDS

SEQ ID NO: 332 - DNA, 1350 bp, Euglena gracilis
  CDS (1)..(1350)
atggctctctcccttactaccgagcagctgctcgagcgacccgacctggttgccatcgacggcattctctacgatctggaaggtcttgccaaggtccatcccggatccgacttgatcctcgcttctggtgcctccgatgcttctcctctgttctactccatgcacccttacgtcaagcccgagaactcgaagctgcttcaacagttcgtgcgaggcaagcacgaccgaacctccaaggacattgtctacacctacgactctccctttgcacaggacgtcaagcgaactatgcgagaggtcatgaaaggtcggaactggtatgccacacctggattctggctgcgaaccgttggcatcattgctgtcaccgccttttgcgagtggcactgggctactaccggaatggtgctgtggggtctcttgactggattcatgcacatgcagatcggcctgtccattcagcacgatgccggtcatggtgccatcagcaaaaagccctgggtcaacgctctctttgcctacggcatcgacgtcattggatcgtccagatggatctggctgcagtctcacatcatgcgacatcacacctacaccaatcagcatggtctcgacctggatgccgagtccgcagaaccattccttgtgttccacaactaccctgctgccaacactgctcgaaagtggtttcaccgattccaggcctggtacatgtacctcgtgcttggagcctacggcgtttcgctggtgtacaaccctctctacatcttccgaatgcagcacaacgacaccattcccgagtctgtcacagccatgcgagagaacggctttctgcgacggtaccgaacccttgcattcgttatgcgagctttcttcatctttcgaaccgccttcttgccctggtatctcactggaacctccctgctcatcaccattcctctggtgcccactgctaccggtgccttcctcaccttctttttcatcttgtctcacaacttcgatggctcggagcgaatccccgacaagaactgcaaggtcaagagctccgagaaggacgttgaagccgatcagatcgactggtacagagctcaggtggagacctcttccacctacggtggacccattgccatgttctttactggcggtctcaacttccagatcgagcatcacctctttcctcgaatgtcgtcttggcactatcccttcgtgcagcaagctgtccgagagtgttgcgaacgacacggagttcggtacgtcttctaccctaccattgtgggcaacatcatttccaccctcaagtacatgcacaaagtcggtgtggttcactgtgtcaaggacgctcaggattcctaa

SEQ ID NO: 333 - protein, 449 aa, Euglena gracilis
MALSLTTEQLLERPDLVAIDGILYDLEGLAKVHPGSDLILASGASDASPLFYSMHPYVKPENSKLLQQFVRGKHDRTSKDIVYTYDSPFAQDVKRTMREVMKGRNWYATPGFWLRTVGIIAVTAFCEWHWATTGMVLWGLLTGFMHMQIGLSIQHDAGHGAISKKPWVNALFAYGIDVIGSSRWIWLQSHIMRHHTYTNQHGLDLDAESAEPFLVFHNYPAANTARKWFHRFQAWYMYLVLGAYGVSLVYNPLYIFRMQHNDTIPESVTAMRENGFLRRYRTLAFVMRAFFIFRTAFLPWYLTGTSLLITIPLVPTATGAFLTFFFILSHNFDGSERIPDKNCKVKSSEKDVEADQIDWYRAQVETSSTYGGPIAMFFTGGLNFQIEHHLFPRMSSWHYPFVQQAVRECCERHGVRYVFYPTIVGNIISTLKYMHKVGVVHCVKDAQDS

SEQ ID NO: 334 - protein, 454 aa, Euglena anabaena
MATISLTTEQLLEHPELVAIDGVLYDLFGLAKVHAGGNLIEAAGASDGTALFYSMHPGVKPENSKLLQQFARGKHERSSKDPVYTFDSPFAQDVKQSVREVMKGRNWYATPGFWLRTALIIACTAIGEWYWITTGAVMWGIFTGYFHSQIGLAIQHDASHGAISKKPWVNAFFAYGIDAIGSSRWIWLQSHIMRHHTYTNQHGLDLDAASAEPFILFHSYPATNASRKWYHRFQAWYMYIVLGMYGVSMVYNPMYLFTMQHNDTIPEATSLRPGSFFNRQRAFAVSLRLLFIFRNAFLPWYIAGASPLLTILLVPTVTGIFLTFVFVLSHNFEGAERTPEKNCKAKRAKEGKEVRDVEEDRVDWYRAQAETAATYGGSVGMMLTGGLNLQIEHHLFPRMSSWHYPFIQDTVRECCKRHGVRYTYYPTILENIMSTLRYMQKVGVAHTIQDAQEF

SEQ ID NO: 335 - DNA, 1362 bp, Euglena anabaena UTEX 373
  CDS (1)..(1362): delta-5 desaturase
  ref <302>: TITLE: DELTA-5 DESATURASES AND THEIR USE IN MAKING POLYUNSATURATED FATTY ACIDS
  ref <310>: PATENT DOCUMENT NUMBER: WO 2008/137532
  ref <311>: PATENT FILING DATE: 2008-05-01
  ref <312>: PUBLICATION DATE: 2008-11-13
  ref <313>: RELEVANT RESIDUES IN SEQ ID NO: (1)..(1362)
  ref <302>: TITLE: DELTA-5 DESATURASES AND THEIR USE IN MAKING POLYUNSATURATED FATTY ACIDS
  ref <310>: PATENT DOCUMENT NUMBER: US-2008-0274521-A1
  ref <311>: PATENT FILING DATE: 2008-04-29
  ref <312>: PUBLICATION DATE: 2008-11-16
  ref <313>: RELEVANT RESIDUES IN SEQ ID NO: (1)..(1362)
atggccaccatctctttgactactgagcaacttttagaacacccagaactggttgcaattgatggggtgttgtacgatctcttcggactggcgaaagtgcatccaggtggcaacctcattgaagccgccggtgcctccgacggaaccgccctgttctactccatgcaccctggagtgaagccagagaattcgaagctgctgcagcaatttgcccgaggcaaacacgaacgaagctcgaaggacccagtgtacacctttgacagtcccttcgcccaggatgtcaagcagagcgttcgggaggtcatgaaggggcgcaactggtacgccacgcccggcttttggctgcggaccgcgctgatcatcgcgtgcactgccataggcgaatggtattggatcactaccggggcagtgatgtggggcatcttcaccgggtacttccacagccagattgggttggcgattcaacacgatgcctctcacggagccatcagcaaaaagccctgggtgaacgcctttttcgcctacggcatcgacgccattggatcctcccgctggatctggctgcagtcccacattatgcgccaccacacctacaccaaccagcatggcctggacctggacgctgcctcggcggagccgttcattttgttccactcctacccggcaacaaatgcgtcacgaaagtggtaccatcggttccaggcgtggtacatgtacatcgttttggggatgtatggtgtgtcgatggtgtacaatccgatgtacttgttcacgatgcagcacaacgacacaatcccagaggccacctctcttagaccaggcagctttttcaaccggcagcgcgccttcgccgtttccctccgcctactgttcatcttccgcaacgccttcctcccctggtacatcgcgggcgcctctccgctgctcaccatcctgctggtgccaacggtcacaggcatcttcttgacatttgtttttgtgctgtcccataactttgaaggcgctgagcggacccccgaaaagaactgcaaggccaaaagggccaaggaggggaaggaggtccgcgatgtagaggaggaccgggtggactggtaccgggcgcaggccgagaccgcggcgacctacgggggcagcgtcgggatgatgctgaccggcggtttgaacctgcagatcgagcaccacttgttcccccgcatgtcctcttggcactaccccttcatccaagatacggtgcgggaatgttgcaagcgccatggcgtgcgctacacatactacccgaccatcctggagaatataatgtccacgctccgctacatgcagaaggtgggcgtggcccacacaattcaggatgcccaggaattc

SEQ ID NO: 336 - protein, 454 aa, Euglena anabaena UTEX 373
MATISLTTEQLLEHPELVAIDGVLYDLFGLAKVHPGGNLIEAAGASDGTALFYSMHPGVKPENSKLLQQFARGKHERSSKDPVYTFDSPFAQDVKQSVREVMKGRNWYATPGFWLRTALIIACTAIGEWYWITTGAVMWGIFTGYFHSQIGLAIQHDASHGAISKKPWVNAFFAYGIDAIGSSRWIWLQSHIMRHHTYTNQHGLDLDAASAEPFILFHSYPATNASRKWYHRFQAWYMYIVLGMYGVSMVYNPMYLFTMQHNDTIPEATSLRPGSFFNRQRAFAVSLRLLFIFRNAFLPWYIAGASPLLTILLVPTVTGIFLTFVFVLSHNFEGAERTPEKNCKAKRAKEGKEVRDVEEDRVDWYRAQAETAATYGGSVGMMLTGGLNLQIEHHLFPRMSSWHYPFIQDTVRECCKRHGVRYTYYPTILENIMSTLRYMQKVGVAHTIQDAQEF

SEQ ID NO: 337 - DNA, 1362 bp, Euglena anabaena UTEX 373
  CDS (1)..(1362): synthetic delta-5 desaturase (codon-optimized for Yarrowia lipolytica)
  ref <302>: TITLE: DELTA-5 DESATURASES AND THEIR USE IN MAKING POLYUNSATURATED FATTY ACIDS
  ref <310>: PATENT DOCUMENT NUMBER: WO 2008/137532
  ref <311>: PATENT FILING DATE: 2008-05-01
  ref <312>: PUBLICATION DATE: 2008-11-13
  ref <313>: RELEVANT RESIDUES IN SEQ ID NO: (1)..(1362)
  ref <302>: TITLE: DELTA-5 DESATURASES AND THEIR USE IN MAKING POLYUNSATURATED FATTY ACIDS
  ref <310>: PATENT DOCUMENT NUMBER: US-2008-0274521-A1
  ref <311>: PATENT FILING DATE: 2008-04-29
  ref <312>: PUBLICATION DATE: 2008-11-06
  ref <313>: RELEVANT RESIDUES IN SEQ ID NO: (1)..(1362)
atggccaccatctccctgactaccgagcagctcctggaacaccccgagctcgttgccatcgacggagtcctgtacgatctcttcggtctggccaaggtgcatccaggaggcaacctcatcgaagctgccggtgcatccgacggaaccgctctgttctactccatgcatcctggagtcaagccagagaactcgaagcttctgcagcaatttgcccgaggcaagcacgaacgaagctccaaggatcccgtgtacaccttcgactctccctttgctcaggacgtcaagcagtccgttcgagaggtcatgaagggtcgaaactggtacgccactcctggcttctggctgagaaccgcactcatcatcgcttgtactgccattggcgagtggtactggatcacaaccggagcagtgatgtggggtatctttactggatacttccactcgcagattggcttggccattcaacacgatgcttctcacggagccatcagcaaaaagccctgggtcaacgcctttttcgcttatggcatcgacgccattggttcctctcgttggatctggctgcagtcccacattatgcgacatcacacttacaccaaccagcatggcctcgacctggatgctgcctcggcagagccgttcatcttgttccactcctatcctgctaccaacgcctctcgaaagtggtaccaccgatttcaggcgtggtacatgtacatcgttctgggaatgtatggtgtctcgatggtgtacaatcccatgtacctcttcacaatgcagcacaacgacaccattcccgaggccacttctctcagaccaggcagctttttcaatcggcagcgagctttcgccgtttcccttcgactgctcttcatcttccgaaacgcctttcttccctggtacattgctggtgcctctcctctgctcaccattcttctggtgcccacggtcacaggcatcttcctcacctttgtgttcgttctgtcccataacttcgagggagccgaacggaccccagagaagaactgcaaggccaaacgagctaaggaaggcaaggaggtcagagacgtggaagaggatcgagtcgactggtaccgagcacaggccgagactgctgccacctacggtggcagcgtgggaatgatgcttacaggcggtctcaacctgcagatcgagcatcacttgtttccccgaatgtcctcttggcactatcccttcattcaagacaccgttcgggagtgttgcaagcgacatggcgtccgttacacatactatcctaccattctcgagaacatcatgtccactcttcgatacatgcagaaggtgggtgttgctcacaccattcaggatgcccaggagttc

SEQ ID NO: 338 - protein, 454 aa, Euglena anabaena UTEX 373; identical to SEQ ID NO: 336

SEQ ID NO: 339 - DNA, 8357 bp, Artificial Sequence
  Plasmid pZuFmEaD5S-A(S)
catggccaccatctccctgactaccgagcagctcctggaacaccccgagctcgttgccatcgacggagtcctgtacgatctcttcggtctggccaaggtccatgccggaggcaacctcatcgaagctgccggtgcatccgacggaaccgctctgttctactccatgcatcctggagtcaagccagagaactcgaagcttctgcagcaatttgcccgaggcaagcacgaacgaagctccaaggatcccgtgtacaccttcgactctccctttgctcaggacgtcaagcagtccgttcgagaggtcatgaagggtcgaaactggtacgccactcctggcttctggctgagaaccgcactcatcatcgcttgtactgccattggcgagtggtactggatcacaaccggagcagtgatgtggggtatctttactggatacttccactcgcagattggcttggccattcaacacgatgcttctcacggagccatcagcaaaaagccctgggtcaacgcctttttcgcttatggcatcgacgccattggttcctctcgttggatctggctgcagtcccacattatgcgacatcacacttacaccaaccagcatggcctcgacctggatgctgcctcggcagagccgttcatcttgttccactcctatcctgctaccaacgcctctcgaaagtggtaccaccgatttcaggcgtggtacatgtacatcgttctgggaatgtatggtgtctcgatggtgtacaatcccatgtacctcttcacaatgcagcacaacgacaccattcccgaggccacttctctcagaccaggcagctttttcaatcggcagcgagctttcgccgtttcccttcgactgctcttcatcttccgaaacgcctttcttccctggtacattgctggtgcctctcctctgctcaccattcttctggtgcccacggtcacaggcatcttcctcacctttgtgttcgttctgtcccataacttcgagggagccgaacggaccccagagaagaactgcaaggccaaacgagctaaggaaggcaaggaggtcagagacgtggaagaggatcgagtcgactggtaccgagcacaggccgagactgctgccacctacggtggcagcgtgggaatgatgcttacaggcggtctcaacctgcagatcgagcatcacttgtttccccgaatgtcctcttggcactatcccttcattcaagacaccgttcgggagtgttgcaagcgacatggcgtccgttacacatactatcctaccattctcgagaacatcatgtccactcttcgatacatgcagaaggtgggtgttgctcacaccattcaggatgcccaggagttctaagcggccgcaagtgtggatggggaagtgagtgcccggttctgtgtgcacaattggcaatccaagatggatggattcaacacagggatatagcgagctacgtggtggtgcgaggatatagcaacggatatttatgtttgacacttgagaatgtacgatacaagcactgtccaagtacaatactaaacatactgtacatactcatactcgtacccgggcaacggtttcacttgagtgcagtggctagtgctcttactcgtacagtgtgcaatactgcgtatcatagtctttgatgtatatcgtattcattcatgttagttgcgtacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggtaccgggccccccctcgaggtcgatggtgtcgataagcttgatatcgaattcatgtcacacaaaccgatcttcgcctcaaggaaacctaattctacatccgagagactgccgagatccagtctacactgattaattttcgggccaataatttaaaaaaatcgtgttatataatattatatgtattatatatatacatcatgatgatactgacagtcatgtcccattgctaaatagacagactccatctgccgcctccaactgatgttctcaatatttaaggggtcatctcgcattgtttaataataaacagactccatctaccgcctccaaatgatgttctcaaaatatattgtatgaacttatttttattacttagtattattagacaacttacttgctttatgaaaaacacttcctatttaggaaacaatttataatggcagttcgttcatttaacaatttatgtagaataaatgttataaatgcgtatgggaaatcttaaatatggatagcataaatgatatctgcattgcctaattcgaaatcaacagcaacgaaaaaaatcccttgtacaacataaatagtcatcgagaaatatcaactatcaaagaacagctattcacacgttactattgagattattattggacgagaatcacacactcaactgtctttctctcttctagaaatacaggtacaagtatgtactattctcattgttcatacttctagtcatttcatcccacatattccttggatttctctccaatgaatgacattctatcttgcaaattcaacaattataataagatataccaaagtagcggtatagtggcaatcaaaaagcttctctggtgtgcttctcgtatttatttttattctaatgatccattaaaggtatatatttatttcttgttatataatccttttgtttattacatgggctggatacataaaggtattttgatttaattttttgcttaaattcaatcccccctcgttcagtgtcaactgtaatggtaggaaattaccatacttttgaagaagcaaaaaaaatgaaagaaaaaaaaaatcgtatttccaggttagacgttccgcagaatctagaatgcggtatgcggtacattgttcttcgaacgtaaaagttgcgctccctgagatattgtacatttttgcttttacaagtacaagtacatcgtacaactatgtactactgttgatgcatccacaacagtttgttttgtttttttttgttttttttttttctaatgattcattaccgctatgtatacctacttgtacttgtagtaagccgggttattggcgttcaattaatcatagacttatgaatctgcacggtgtgcgctgcgagttacttttagcttatgcatgctacttgggtgtaatattgggatctgttcggaaatcaacggatgctcaatcgatttcgacagtaattaattaagtcatacacaagtcagctttcttcgagcctcatataagtataagtagttcaacgtattagcactgtacccagcatctccgtatcgagaaacacaacaacatgccccattggacagatcatgcggatacacaggttgtgcagtatcatacatactcgatcagacaggtcgtctgaccatcatacaagctgaacaagcgctccatacttgcacgctctctatatacacagttaaattacatatccatagtctaacctctaacagttaatcttctggtaagcctcccagccagccttctggtatcgcttggcctcctcaataggatctcggttctggccgtacagacctcggccgacaattatgatatccgttccggtagacatgacatcctcaacagttcggtactgctgtccgagagcgtctcccttgtcgtcaagacccaccccgggggtcagaataagccagtcctcagagtcgcccttaggtcggttctgggcaatgaagccaaccacaaactcggggtcggatcgggcaagctcaatggtctgcttggagtactcgccagtggccagagagcccttgcaagacagctcggccagcatgagcagacctctggccagcttctcgttgggagaggggactaggaactccttgtactgggagttctcgtagtcagagacgtcctccttcttctgttcagagacagtttcctcggcaccagctcgcaggccagcaatgattccggttccgggtacaccgtgggcgttggtgatatcggaccactcggcgattcggtgacaccggtactggtgcttgacagtgttgccaatatctgcgaactttctgtcctcgaacaggaagaaaccgtgcttaagagcaagttccttgagggggagcacagtgccggcgtaggtgaagtcgtcaatgatgtcgatatgggttttgatcatgcacacataaggtccgaccttatcggcaagctcaatgagctccttggtggtggtaacatccagagaagcacacaggttggttttcttggctgccacgagcttgagcactcgagcggcaaaggcggacttgtggacgttagctcgagcttcgtaggagggcattttggtggtgaagaggagactgaaataaatttagtctgcagaactttttatcggaaccttatctggggcagtgaagtatatgttatggtaatagttacgagttagttgaacttatagatagactggactatacggctatcggtccaaattagaaagaacgtcaatggctctctgggcgtcgcctttgccgacaaaaatgtgatcatgatgaaagccagcaatgacgttgcagctgatattgttgtcggccaaccgcgccgaaaacgcagctgtcagacccacagcctccaacgaagaatgtatcgtcaaagtgatccaagcacactcatagttggagtcgtactccaaaggcggcaatgacgagtcagacagatactcgtcgacgtttaaacagtgtacgcagatctactatagaggaacatttaaattgccccggagaagacggccaggccgcctagatgacaaattcaacaactcacagctgactttctgccattgccactaggggggggcctttttatatggccaagccaagctctccacgtcggttgggctgcacccaacaataaatgggtagggttgcaccaacaaagggatgggatggggggtagaagatacgaggataacggggctcaatggcacaaataagaacgaatactgccattaagactcgtgatccagcgactgacaccattgcatcatctaagggcctcaaaactacctcggaactgctgcgctgatctggacaccacagaggttccgagcactttaggttgcaccaaatgtcccaccaggtgcaggcagaaaacgctggaacagcgtgtacagtttgtcttaacaaaaagtgagggcgctgaggtcgagcagggtggtgtgacttgttatagcctttagagctgcgaaagcgcgtatggatttggctcatcaggccagattgagggtctgtggacacatgtcatgttagtgtacttcaatcgccccctggatatagccccgacaataggccgtggcctcatttttttgccttccgcacatttccattgctcgatacccacaccttgcttctcctgcacttgccaaccttaatactggtttacattgaccaacatcttacaagcggggggcttgtctagggtatatataaacagtggctctcccaatcggttgccagtctcttttttcctttctttccccacagattcgaaatctaaactacacatcacagaattccgagccgtgagtatccacgacaagatcagtgtcgagacgacgcgttttgtgtaatgacacaatccgaaagtcgctagcaacacacactctctacacaaactaacccagctctggtac

SEQ ID NO: 340 - DNA, 32 bp, Artificial Sequence
  Primer
ttggccattcaacacgaggcttctcacggagc

SEQ ID NO: 341 - DNA, 32 bp, Artificial Sequence
  Primer
gctccgtgagaagcctcgtgttgaatggccaa

SEQ ID NO: 342 - DNA, 44 bp, Artificial Sequence
  Primer
gattggcttggccattcaacacgatttctctcacggagccatca

SEQ ID NO: 343 - DNA, 44 bp, Artificial Sequence
  Primer
tgatggctccgtgagagaaatcgtgttgaatggccaagccaatc

SEQ ID NO: 344 - DNA, 33 bp, Artificial Sequence
  Primer
gccattcaacacgatggttctcacggagccatc

SEQ ID NO: 345 - DNA, 33 bp, Artificial Sequence
  Primer
gatggctccgtgagaaccatcgtgttgaatggc

SEQ ID NO: 346 - DNA, 44 bp, Artificial Sequence
  Primer
gattggcttggccattcaacacgatatgtctcacggagccatca

SEQ ID NO: 347 - DNA, 44 bp, Artificial Sequence
  Primer
tgatggctccgtgagacatatcgtgttgaatggccaagccaatc

SEQ ID NO: 348 - DNA, 37 bp, Artificial Sequence
  Primer
ggcttggccattcaacacgattcctctcacggagcca

SEQ ID NO: 349 - DNA, 37 bp, Artificial Sequence
  Primer
tggctccgtgagaggaatcgtgttgaatggccaagcc

SEQ ID NO: 350 - DNA, 44 bp, Artificial Sequence
  Primer
gattggcttggccattcaacacgattactctcacggagccatca

SEQ ID NO: 351 - DNA, 44 bp, Artificial Sequence
  Primer
tgatggctccgtgagagtaatcgtgttgaatggccaagccaatc

SEQ ID NO: 352 - DNA, 37 bp, Artificial Sequence
  Primer
ccattcaacacgatgctgcccacggagccatcagcaa

SEQ ID NO: 353 - DNA, 37 bp, Artificial Sequence
  Primer
ttgctgatggctccgtgggcagcatcgtgttgaatgg

SEQ ID NO: 354 - DNA, 32 bp, Artificial Sequence
  Primer
ggccattcaacacgatgcttgtcacggagcca

SEQ ID NO: 355 - DNA, 32 bp, Artificial Sequence
  Primer
tggctccgtgacaagcatcgtgttgaatggcc

SEQ ID NO: 356 - DNA, 36 bp, Artificial Sequence
  Primer
cttggccattcaacacgatgctggtcacggagccat

SEQ ID NO: 357 - DNA, 36 bp, Artificial Sequence
  Primer
atggctccgtgaccagcatcgtgttgaatggccaag

SEQ ID NO: 358 - DNA, 45 bp, Artificial Sequence
  Primer
ttggccattcaacacgatgctaaccacggagccatcagcaaaaag

SEQ ID NO: 359 - DNA, 45 bp, Artificial Sequence
  Primer
ctttttgctgatggctccgtggttagcatcgtgttgaatggccaa

SEQ ID NO: 360 - DNA, 37 bp, Artificial Sequence
  Primer
ccattcaacacgatgctacccacggagccatcagcaa

SEQ ID NO: 361 - DNA, 37 bp, Artificial Sequence
  Primer
ttgctgatggctccgtgggtagcatcgtgttgaatgg

SEQ ID NO: 362 - DNA, 1365 bp, Euglena anabaena
  CDS (1)..(1365)
atggccaccatctccctgactaccgagcagctcctggaacaccccgagctcgttgccatcgacggagtcctgtacgatctcttcggtctggccaaggtccatgccggaggcaacctcatcgaagctgccggtgcatccgacggaaccgctctgttctactccatgcatcctggagtcaagccagagaactcgaagcttctgcagcaatttgcccgaggcaagcacgaacgaagctccaaggatcccgtgtacaccttcgactctccctttgctcaggacgtcaagcagtccgttcgagaggtcatgaagggtcgaaactggtacgccactcctggcttctggctgagaaccgcactcatcatcgcttgtactgccattggcgagtggtactggatcacaaccggagcagtgatgtggggtatctttactggatacttccactcgcagattggcttggccattcaacacgattcctctcacggagccatcagcaaaaagccctgggtcaacgcctttttcgcttatggcatcgacgccattggttcctctcgttggatctggctgcagtcccacattatgcgacatcacacttacaccaaccagcatggcctcgacctggatgctgcctcggcagagccgttcatcttgttccactcctatcctgctaccaacgcctctcgaaagtggtaccaccgatttcaggcgtggtacatgtacatcgttctgggaatgtatggtgtctcgatggtgtacaatcccatgtacctcttcacaatgcagcacaacgacaccattcccgaggccacttctctcagaccaggcagctttttcaatcggcagcgagctttcgccgtttcccttcgactgctcttcatcttccgaaacgcctttcttccctggtacattgctggtgcctctcctctgctcaccattcttctggtgcccacggtcacaggcatcttcctcacctttgtgttcgttctgtcccataacttcgagggagccgaacggaccccagagaagaactgcaaggccaaacgagctaaggaaggcaaggaggtcagagacgtggaagaggatcgagtcgactggtaccgagcacaggccgagactgctgccacctacggtggcagcgtgggaatgatgcttacaggcggtctcaacctgcagatcgagcatcacttgtttccccgaatgtcctcttggcactatcccttcattcaagacaccgttcgggagtgttgcaagcgacatggcgtccgttacacatactatcctaccattctcgagaacatcatgtccactcttcgatacatgcagaaggtgggtgttgctcacaccattcaggatgcccaggagttctaa

SEQ ID NO: 363 - protein, 454 aa, Euglena anabaena
MATISLTTEQLLEHPELVAIDGVLYDLFGLAKVHAGGNLIEAAGASDGTALFYSMHPGVKPENSKLLQQFARGKHERSSKDPVYTFDSPFAQDVKQSVREVMKGRNWYATPGFWLRTALIIACTAIGEWYWITTGAVMWGIFTGYFHSQIGLAIQHDSSHGAISKKPWVNAFFAYGIDAIGSSRWIWLQSHIMRHHTYTNQHGLDLDAASAEPFILFHSYPATNASRKWYHRFQAWYMYIVLGMYGVSMVYNPMYLFTMQHNDTIPEATSLRPGSFFNRQRAFAVSLRLLFIFRNAFLPWYIAGASPLLTILLVPTVTGIFLTFVFVLSHNFEGAERTPEKNCKAKRAKEGKEVRDVEEDRVDWYRAQAETAATYGGSVGMMLTGGLNLQIEHHLFPRMSSWHYPFIQDTVRECCKRHGVRYTYYPTILENIMSTLRYMQKVGVAHTIQDAQEF

SEQ ID NO: 364 - DNA, 1365 bp, Euglena anabaena
  CDS (1)..(1365)
atggccaccatctccctgactaccgagcagctcctggaacaccccgagctcgttgccatcgacggagtcctgtacgatctcttcggtctggccaaggtccatgccggaggcaacctcatcgaagctgccggtgcatccgacggaaccgctctgttctactccatgcatcctggagtcaagccagagaactcgaagcttctgcagcaatttgcccgaggcaagcacgaacgaagctccaaggatcccgtgtacaccttcgactctccctttgctcaggacgtcaagcagtccgttcgagaggtcatgaagggtcgaaactggtacgccactcctggcttctggctgagaaccgcactcatcatcgcttgtactgccattggcgagtggtactggatcacaaccggagcagtgatgtggggtatctttactggatacttccactcgcagattggcttggccattcaacacgatgctggtcacggagccatcagcaaaaagccctgggtcaacgcctttttcgcttatggcatcgacgccattggttcctctcgttggatctggctgcagtcccacattatgcgacatcacacttacaccaaccagcatggcctcgacctggatgctgcctcggcagagccgttcatcttgttccactcctatcctgctaccaacgcctctcgaaagtggtaccaccgatttcaggcgtggtacatgtacatcgttctgggaatgtatggtgtctcgatggtgtacaatcccatgtacctcttcacaatgcagcacaacgacaccattcccgaggccacttctctcagaccaggcagctttttcaatcggcagcgagctttcgccgtttcccttcgactgctcttcatcttccgaaacgcctttcttccctggtacattgctggtgcctctcctctgctcaccattcttctggtgcccacggtcacaggcatcttcctcacctttgtgttcgttctgtcccataacttcgagggagccgaacggaccccagagaagaactgcaaggccaaacgagctaaggaaggcaaggaggtcagagacgtggaagaggatcgagtcgactggtaccgagcacaggccgagactgctgccacctacggtggcagcgtgggaatgatgcttacaggcggtctcaacctgcagatcgagcatcacttgtttccccgaatgtcctcttggcactatcccttcattcaagacaccgttcgggagtgttgcaagcgacatggcgtccgttacacatactatcctaccattctcgagaacatcatgtccactcttcgatacatgcagaaggtgggtgttgctcacaccattcaggatgcccaggagttctaa

SEQ ID NO: 365 - protein, 454 aa, Euglena anabaena
MATISLTTEQLLEHPELVAIDGVLYDLFGLAKVHAGGNLIEAAGASDGTALFYSMHPGVKPENSKLLQQFARGKHERSSKDPVYTFDSPFAQDVKQSVREVMKGRNWYATPGFWLRTALIIACTAIGEWYWITTGAVMWGIFTGYFHSQIGLAIQHDAGHGAISKKPWVNAFFAYGIDAIGSSRWIWLQSHIMRHHTYTNQHGLDLDAASAEPFILFHSYPATNASRKWYHRFQAWYMYIVLGMYGVSMVYNPMYLFTMQHNDTIPEATSLRPGSFFNRQRAFAVSLRLLFIFRNAFLPWYIAGASPLLTILLVPTVTGIFLTFVFVLSHNFEGAERTPEKNCKAKRAKEGKEVRDVEEDRVDWYRAQAETAATYGGSVGMMLTGGLNLQIEHHLFPRMSSWHYPFIQDTVRECCKRHGVRYTYYPTILENIMSTLRYMQKVGVAHTIQDAQEF

SEQ ID NO: 366 - DNA, 25 bp, Artificial Sequence
  Primer FBAIN-F
caagcggggggcttgtctagggtat

SEQ ID NO: 367 - DNA, 40 bp, Artificial Sequence
  Primer Y1026
tttgcggccgctcactgaatctttttggctcccttgtgct

SEQ ID NO: 368 - DNA, 777 bp, Euglena gracilis
  CDS (1)..(777): mutant delta-9 elongase "EgD9eS-L35G/W132T/I179R"
atggaggtcgtgaacgaaatcgtctccattggccaggaggttcttcccaaggtcgactatgctcagctctggtctgatgcctcgcactgcgaggtgctgtacgggtccatcgccttcgtcatcctgaagttcacccttggtcctctcggacccaagggtcagtctcgaatgaagtttgtgttcaccaactacaacctgctcatgtccatctactcgctgggctccttcctctctatggcctacgccatgtacaccattggtgtcatgtccgacaactgcgagaaggctttcgacaacaatgtcttccgaatcaccactcagctgttctacctcagcaagttcctcgagtacattgactccttctatctgcccctcatgggcaagcctctgaccaccttgcagttctttcaccatctcggagctcctatggacatgtggctgttctacaactaccgaaacgaagccgtttggatctttgtgctgctcaacggcttcattcactggatcatgtacggctactattggacccgactgcgaaagctcaagttccctatgcccaagtccctgattacttctatgcagatcattcagttcaacgttggcttctacatcgtctggaagtaccggaacattccctgctaccgacaagatggaatgagaatgtttggctggtttttcaactacttctacgttggtactgtcctgtgtctgttcctcaacttctacgtgcagacctacatcgtccgaaagcacaagggagccaaaaagattcagtga

SEQ ID NO: 369 - protein, 258 aa, Euglena gracilis
MEVVNEIVSIGQEVLPKVDYAQLWSDASHCEVLYGSIAFVILKFTLGPLGPKGQSRMKFVFTNYNLLMSIYSLGSFLSMAYAMYTIGVMSDNCEKAFDNNVFRITTQLFYLSKFLEYIDSFYLPLMGKPLTTLQFFHHLGAPMDMWLFYNYRNEAVWIFVLLNGFIHWIMYGYYWTRLRKLKFPMPKSLITSMQIIQFNVGFYIVWKYRNIPCYRQDGMRMFGWFFNYFYVGTVLCLFLNFYVQTYIVRKHKGAKKIQ

SEQ ID NO: 370 - DNA, 7769 bp, Artificial Sequence
  Plasmid EgD9eS-L35G/W132T/I179R
ggccgcaagtgtggatggggaagtgagtgcccggttctgtgtgcacaattggcaatccaagatggatggattcaacacagggatatagcgagctacgtggtggtgcgaggatatagcaacggatatttatgtttgacacttgagaatgtacgatacaagcactgtccaagtacaatactaaacatactgtacatactcatactcgtacccgggcaacggtttcacttgagtgcagtggctagtgctcttactcgtacagtgtgcaatactgcgtatcatagtctttgatgtatatcgtattcattcatgttagttgcgtacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggtaccgggccccccctcgaggtcgatggtgtcgataagcttgatatcgaattcatgtcacacaaaccgatcttcgcctcaaggaaacctaattctacatccgagagactgccgagatccagtctacactgattaattttcgggccaataatttaaaaaaatcgtgttatataatattatatgtattatatatatacatcatgatgatactgacagtcatgtcccattgctaaatagacagactccatctgccgcctccaactgatgttctcaatatttaaggggtcatctcgcattgtttaataataaacagactccatctaccgcctccaaatgatgttctcaaaatatattgtatgaacttatttttattacttagtattattagacaacttacttgctttatgaaaaacacttcctatttaggaaacaatttataatggcagttcgttcatttaacaatttatgtagaataaatgttataaatgcgtatgggaaatcttaaatatggatagcataaatgatatctgcattgcctaattcgaaatcaacagcaacgaaaaaaatcccttgtacaacataaatagtcatcgagaaatatcaactatcaaagaacagctattcacacgttactattgagattattattggacgagaatcacacactcaactgtctttctctcttctagaaatacaggtacaagtatgtactattctcattgttcatacttctagtcatttcatcccacatattccttggatttctctccaatgaatgacattctatcttgcaaattcaacaattataataagatataccaaagtagcggtatagtggcaatcaaaaagcttctctggtgtgcttctcgtatttatttttattctaatgatccattaaaggtatatatttatttcttgttatataatccttttgtttattacatgggctggatacataaaggtattttgatttaattttttgcttaaattcaatcccccctcgttcagtgtcaactgtaatggtaggaaattaccatacttttgaagaagcaaaaaaaatgaaagaaaaaaaaaatcgtatttccaggttagacgttccgcagaatctagaatgcggtatgcggtacattgttcttcgaacgtaaaagttgcgctccctgagatattgtacatttttgcttttacaagtacaagtacatcgtacaactatgtactactgttgatgcatccacaacagtttgttttgtttttttttgttttttttttttctaatgattcattaccgctatgtatacctacttgtacttgtagtaagccgggttattggcgttcaattaatcatagacttatgaatctgcacggtgtgcgctgcgagttacttttagcttatgcatgctacttgggtgtaatattgggatctgttcggaaatcaacggatgctcaatcgatttcgacagtaattaattaagtcatacacaagtcagctttcttcgagcctcatataagtataagtagttcaacgtattagcactgtacccagcatctccgtatcgagaaacacaacaacatgccccattggacagatcatgcggatacacaggttgtgcagtatcatacatactcgatcagacaggtcgtctgaccatcatacaagctgaacaagcgctccatacttgcacgctctctatatacacagttaaattacatatccatagtctaacctctaacagttaatcttctggtaagcctcccagccagccttctggtatcgcttggcctcctcaataggatctcggttctggccgtacagacctcggccgacaattatgatatccgttccggtagacatgacatcctcaacagttcggtactgctgtccgagagcgtctcccttgtcgtcaagacccaccccgggggtcagaataagccagtcctcagagtcgcccttaggtcggttctgggcaatgaagccaaccacaaactcggggtcggatcgggcaagctcaatggtctgcttggagtactcgccagtggccagagagcccttgcaagacagctcggccagcatgagcagacctctggccagcttctcgttgggagaggggactaggaactccttgtactgggagttctcgtagtcagagacgtcctccttcttctgttcagagacagtttcctcggcaccagctcgcaggccagcaatgattccggttccgggtacaccgtgggcgttggtgatatcggaccactcggcgattcggtgacaccggtactggtgcttgacagtgttgccaatatctgcgaactttctgtcctcgaacaggaagaaaccgtgcttaagagcaagttccttgagggggagcacagtgccggcgtaggtgaagtcgtcaatgatgtcgatatgggttttgatcatgcacacataaggtccgaccttatcggcaagctcaatgagctccttggtggtggtaacatccagagaagcacacaggttggttttcttggctgccacgagcttgagcactcgagcggcaaaggcggacttgtggacgttagctcgagcttcgtaggagggcattttggtggtgaagaggagactgaaataaatttagtctgcagaactttttatcggaaccttatctggggcagtgaagtatatgttatggtaatagttacgagttagttgaacttatagatagactggactatacggctatcggtccaaattagaaagaacgtcaatggctctctgggcgtcgcctttgccgacaaaaatgtgatcatgatgaaagccagcaatgacgttgcagctgatattgttgtcggccaaccgcgccgaaaacgcagctgtcagacccacagcctccaacgaagaatgtatcgtcaaagtgatccaagcacactcatagttggagtcgtactccaaaggcggcaatgacgagtcagacagatactcgtcgacgtttaaacagtgtacgcagatctactatagaggaacatttaaattgccccggagaagacggccaggccgcctagatgacaaattcaacaactcacagctgactttctgccattgccactaggggggggcctttttatatggccaagccaagctctccacgtcggttgggctgcacccaacaataaatgggtagggttgcaccaacaaagggatgggatggggggtagaagatacgaggataacggggctcaatggcacaaataagaacgaatactgccattaagactcgtgatccagcgactgacaccattgcatcatctaagggcctcaaaactacctcggaactgctgcgctgatctggacaccacagaggttccgagcactttaggttgcaccaaatgtcccaccaggtgcaggcagaaaacgctggaacagcgtgtacagtttgtcttaacaaaaagtgagggcgctgaggtcgagcagggtggtgtgacttgttatagcctttagagctgcgaaagcgcgtatggatttggctcatcaggccagattgagggtctgtggacacatgtcatgttagtgtacttcaatcgccccctggatatagccccgacaataggccgtggcctcatttttttgccttccgcacatttccattgctcgatacccacaccttgcttctcctgcacttgccaaccttaatactggtttacattgaccaacatcttacaagcggggggcttgtctagggtatatataaacagtggctctcccaatcggttgccagtctcttttttcctttctttccccacagattcgaaatctaaactacacatcacagaattccgagccgtgagtatccacgacaagatcagtgtcgagacgacgcgttttgtgtaatgacacaatccgaaagtcgctagcaacacacactctctacacaaactaacccagctctggtaccatggaggtcgtgaacgaaatcgtctccattggccaggaggttcttcccaaggtcgactatgctcagctctggtctgatgcctcgcactgcgaggtgctgtacgggtccatcgccttcgtcatcctgaagttcacccttggtcctctcggacccaagggtcagtctcgaatgaagtttgtgttcaccaactacaacctgctcatgtccatctactcgctgggctccttcctctctatggcctacgccatgtacaccattggtgtcatgtccgacaactgcgagaaggctttcgacaacaatgtcttccgaatcaccactcagctgttctacctcagcaagttcctcgagtacattgactccttctatctgcccctcatgggcaagcctctgaccaccttgcagttctttcaccatctcggagctcctatggacatgtggctgttctacaactaccgaaacgaagccgtttggatctttgtgctgctcaacggcttcattcactggatcatgtacggctactattggacccgactgcgaaagctcaagttccctatgcccaagtccctgattacttctatgcagatcattcagttcaacgttggcttctacatcgtctggaagtaccggaacattccctgctaccgacaagatggaatgagaatgtttggctggtttttcaactacttctacgttggtactgtcctgtgtctgttcctcaacttctacgtgcagacctacatcgtccgaaagcacaagggagccaaaaagattcagtgagc

SEQ ID NO: 371 - DNA, 777 bp, Euglena gracilis
  CDS (1)..(777): mutant delta-9 elongase "EgD9eS-S9D/L35G/Y84C/I179R"
atggaggtcgtgaacgaaatcgtcgacattggccaggaggttcttcccaaggtcgactatgctcagctctggtctgatgcctcgcactgcgaggtgctgtacgggtccatcgccttcgtcatcctgaagttcacccttggtcctctcggacccaagggtcagtctcgaatgaagtttgtgttcaccaactacaacctgctcatgtccatctactcgctgggctccttcctctctatggcctacgccatgtgtaccattggtgtcatgtccgacaactgcgagaaggctttcgacaacaatgtcttccgaatcaccactcagctgttctacctcagcaagttcctcgagtacattgactccttctatctgcccctcatgggcaagcctctgacctggttgcagttctttcaccatctcggagctcctatggacatgtggctgttctacaactaccgaaacgaagccgtttggatctttgtgctgctcaacggcttcattcactggatcatgtacggctactattggacccgactgcgaaagctcaagttccctatgcccaagtccctgattacttctatgcagatcattcagttcaacgttggcttctacatcgtctggaagtaccggaacattccctgctaccgacaagatggaatgagaatgtttggctggtttttcaactacttctacgttggtactgtcctgtgtctgttcctcaacttctacgtgcagacctacatcgtccgaaagcacaagggagccaaaaagattcagtga

SEQ ID NO: 372 - protein, 258 aa, Euglena gracilis
MEVVNEIVDIGQEVLPKVDYAQLWSDASHCEVLYGSIAFVILKFTLGPLGPKGQSRMKFVFTNYNLLMSIYSLGSFLSMAYAMCTIGVMSDNCEKAFDNNVFRITTQLFYLSKFLEYIDSFYLPLMGKPLTWLQFFHHLGAPMDMWLFYNYRNEAVWIFVLLNGFIHWIMYGYYWTRLRKLKFPMPKSLITSMQIIQFNVGFYIVWKYRNIPCYRQDGMRMFGWFFNYFYVGTVLCLFLNFYVQTYIVRKHKGAKKIQ

SEQ ID NO: 373 - DNA, 7769 bp, Artificial Sequence
  Plasmid EgD9eS-S9D/L35G/Y84C/I179R
ggccgcaagtgtggatggggaagtgagtgcccggttctgtgtgcacaattggcaatccaagatggatggattcaacacagggatatagcgagctacgtggtggtgcgaggatatagcaacggatatttatgtttgacacttgagaatgtacgatacaagcactgtccaagtacaatactaaacatactgtacatactcatactcgtacccgggcaacggtttcacttgagtgcagtggctagtgctcttactcgtacagtgtgcaatactgcgtatcatagtctttgatgtatatcgtattcattcatgttagttgcgtacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggtaccgggccccccctcgaggtcgatggtgtcgataagcttgatatcgaattcatgtcacacaaaccgatcttcgcctcaaggaaacctaattctacatccgagagactgccgagatccagtctacactgattaattttcgggccaataatttaaaaaaatcgtgttatataatattatatgtattatatatatacatcatgatgatactgacagtcatgtcccattgctaaatagacagactccatctgccgcctccaactgatgttctcaatatttaaggggtcatctcgcattgtttaataataaacagactccatctaccgcctccaaatgatgttctcaaaatatattgtatgaacttatttttattacttagtattattagacaacttacttgctttatgaaaaacacttcctatttaggaaacaatttataatggcagttcgttcatttaacaatttatgtagaataaatgttataaatgcgtatgggaaatcttaaatatggatagcataaatgatatctgcattgcctaattcgaaatcaacagcaacgaaaaaaatcccttgtacaacataaatagtcatcgagaaatatcaactatcaaagaacagctattcacacgttactattgagattattattggacgagaatcacacactcaactgtctttctctcttctagaaatacaggtacaagtatgtactattctcattgttcatacttctagtcatttcatcccacatattccttggatttctctccaatgaatgacattctatcttgcaaattcaacaattataataagatataccaaagtagcggtatagtggcaatcaaaaagcttctctggtgtgcttctcgtatttatttttattctaatgatccattaaaggtatatatttatttcttgttatataatccttttgtttattacatgggctggatacataaaggtattttgatttaattttttgcttaaattcaatcccccctcgttcagtgtcaactgtaatggtaggaaattaccatacttttgaagaagcaaaaaaaatgaaagaaaaaaaaaatcgtatttccaggttagacgttccgcagaatctagaatgcggtatgcggtacattgttcttcgaacgtaaaagttgcgctccctgagatattgtacatttttgcttttacaagtacaagtacatcgtacaactatgtactactgttgatgcatccacaacagtttgttttgtttttttttgttttttttttttctaatgattcattaccgctatgtatacctacttgtacttgtagtaagccgggttattggcgttcaattaatcatagacttatgaatctgcacggtgtgcgctgcgagttacttttagcttatgcatgctacttgggtgtaatattgggatctgttcggaaatcaacggatgctcaatcgatttcgacagtaattaattaagtcatacacaagtcagctttcttcgagcctcatataagtataagtagttcaacgtattagcactgtacccagcatctccgtatcgagaaacacaacaacatgccccattggacagatcatgcggatacacaggttgtgcagtatcatacatactcgatcagacaggtcgtctgaccatcatacaagctgaacaagcgctccatacttgcacgctctctatatacacagttaaattacatatccatagtctaacctctaacagttaatcttctggtaagcctcccagccagccttctggtatcgcttggcctcctcaataggatctcggttctggccgtacagacctcggccgacaattatgatatccgttccggtagacatgacatcctcaacagttcggtactgctgtccgagagcgtctcccttgtcgtcaagacccaccccgggggtcagaataagccagtcctcagagtcgcccttaggtcggttctgggcaatgaagccaaccacaaactcggggtcggatcgggcaagctcaatggtctgcttggagtactcgccagtggccagagagcccttgcaagacagctcggccagcatgagcagacctctggccagcttctcgttgggagaggggactaggaactccttgtactgggagttctcgtagtcagagacgtcctccttcttctgttcagagacagtttcctcggcaccagctcgcaggccagcaatgattccggttccgggtacaccgtgggcgttggtgatatcggaccactcggcgattcggtgacaccggtactggtgcttgacagtgttgccaatatctgcgaactttctgtcctcgaacaggaagaaaccgtgcttaagagcaagttccttgagggggagcacagtgccggcgtaggtgaagtcgtcaatgatgtcgatatgggttttgatcatgcacacataaggtccgaccttatcggcaagctcaatgagctccttggtggtggtaacatccagagaagcacacaggttggttttcttggctgccacgagcttgagcactcgagcggcaaaggcggacttgtggacgttagctcgagcttcgtaggagggcattttggtggtgaagaggagactgaaataaatttagtctgcagaactttttatcggaaccttatctggggcagtgaagtatatgttatggtaatagttacgagttagttgaacttatagatagactggactatacggctatcggtccaaattagaaagaacgtcaatggctctctgggcgtcgcctttgccgacaaaaatgtgatcatgatgaaagccagcaatgacgttgcagctgatattgttgtcggccaaccgcgccgaaaacgcagctgtcagacccacagcctccaacgaagaatgtatcgtcaaagtgatccaagcacactcatagttggagtcgtactccaaaggcggcaatgacgagtcagacagatactcgtcgacgtttaaacagtgtacgcagatctactatagaggaacatttaaattgccccggagaagacggccaggccgcctagatgacaaattcaacaactcacagctgactttctgccattgccactaggggggggcctttttatatggccaagccaagctctccacgtcggttgggctgcacccaacaataaatgggtagggttgcaccaacaaagggatgggatggggggtagaagatacgaggataacggggctcaatggcacaaataagaacgaatactgccattaagactcgtgatccagcgactgacaccattgcatcatctaagggcctcaaaactacctcggaactgctgcgctgatctggacaccacagaggttccgagcactttaggttgcaccaaatgtcccaccaggtgcaggcagaaaacgctggaacagcgtgtacagtttgtcttaacaaaaagtgagggcgctgaggtcgagcagggtggtgtgacttgttatagcctttagagctgcgaaagcgcgtatggatttggctcatcaggccagattgagggtctgtggacacatgtcatgttagtgtacttcaatcgccccctggatatagccccgacaataggccgtggcctcatttttttgccttccgcacatttccattgctcgatacccacaccttgcttctcctgcacttgccaaccttaatactggtttacattgaccaacatcttacaagcggggggcttgtctagggtatatataaacagtggctctcccaatcggttgccagtctcttttttcctttctttccccacagattcgaaatctaaactacacatcacagaattccgagccgtgagtatccacgacaagatcagtgtcgagacgacgcgttttgtgtaatgacacaatccgaaagtcgctagcaacacacactctctacacaaactaacccagctctggtaccatggaggtcgtgaacgaaatcgtcgacattggccaggaggttcttcccaaggtcgactatgctcagctctggtctgatgcctcgcactgcgaggtgctgtacgggtccatcgccttcgtcatcctgaagttcacccttggtcctctcggacccaagggtcagtctcgaatgaagtttgtgttcaccaactacaacctgctcatgtccatctactcgctgggctccttcctctctatggcctacgccatgtgtaccattggtgtcatgtccgacaactgcgagaaggctttcgacaacaatgtcttccgaatcaccactcagctgttctacctcagcaagttcctcgagtacattgactccttctatctgcccctcatgggcaagcctctgacctggttgcagttctttcaccatctcggagctcctatggacatgtggctgttctacaactaccgaaacgaagccgtttggatctttgtgctgctcaacggcttcattcactggatcatgtacggctactattggacccgactgcgaaagctcaagttccctatgcccaagtccctgattacttctatgcagatcattcagttcaacgttggcttctacatcgtctggaagtaccggaacattccctgctaccgacaagatggaatgagaatgtttggctggtttttcaactacttctacgttggtactgtcctgtgtctgttcctcaacttctacgtgcagacctacatcgtccgaaagcacaagggagccaaaaagattcagtgagc

SEQ ID NO: 374 - DNA, 777 bp, Euglena gracilis
  CDS (1)..(777): mutant delta-9 elongase "EgD9eS-L35G/Y84C/I179R/Q244N"
atggaggtcgtgaacgaaatcgtctccattggccaggaggttcttcccaaggtcgactatgctcagctctggtctgatgcctcgcactgcgaggtgctgtacgggtccatcgccttcgtcatcctgaagttcacccttggtcctctcggacccaagggtcagtctcgaatgaagtttgtgttcaccaactacaacctgctcatgtccatctactcgctgggctccttcctctctatggcctacgccatgtgtaccattggtgtcatgtccgacaactgcgagaaggctttcgacaacaatgtcttccgaatcaccactcagctgttctacctcagcaagttcctcgagtacattgactccttctatctgcccctcatgggcaagcctctgacctggttgcagttctttcaccatctcggagctcctatggacatgtggctgttctacaactaccgaaacgaagccgtttggatctttgtgctgctcaacggcttcattcactggatcatgtacggctactattggacccgactgcgaaagctcaagttccctatgcccaagtccctgattacttctatgcagatcattcagttcaacgttggcttctacatcgtctggaagtaccggaacattccctgctaccgacaagatggaatgagaatgtttggctggtttttcaactacttctacgttggtactgtcctgtgtctgttcctcaacttctacgtgaacacctacatcgtccgaaagcacaagggagccaaaaagattcagtga

SEQ ID NO: 375 - protein, 258 aa, Euglena gracilis
MEVVNEIVSIGQEVLPKVDYAQLWSDASHCEVLYGSIAFVILKFTLGPLGPKGQSRMKFVFTNYNLLMSIYSLGSFLSMAYAMCTIGVMSDNCEKAFDNNVFRITTQLFYLSKFLEYIDSFYLPLMGKPLTWLQFFHHLGAPMDMWLFYNYRNEAVWIFVLLNGFIHWIMYGYYWTRLRKLKFPMPKSLITSMQIIQFNVGFYIVWKYRNIPCYRQDGMRMFGWFFNYFYVGTVLCLFLNFYVNTYIVRKHKGAKKIQ

SEQ ID NO: 376 - DNA, 7769 bp, Artificial Sequence
  Plasmid EgD9eS-L35G/Y84C/I179R/Q244N
ggccgcaagtgtggatggggaagtgagtgcccggttctgtgtgcacaattggcaatccaagatggatggattcaacacagggatatagcgagctacgtggtggtgcgaggatatagcaacggatatttatgtttgacacttgagaatgtacgatacaagcactgtccaagtacaatactaaacatactgtacatactcatactcgtacccgggcaacggtttcacttgagtgcagtggctagtgctcttactcgtacagtgtgcaatactgcgtatcatagtctttgatgtatatcgtattcattcatgttagttgcgtacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggtaccgggccccccctcgaggtcgatggtgtcgataagcttgatatcgaattcatgtcacacaaaccgatcttcgcctcaaggaaacctaattctacatccgagagactgccgagatccagtctacactgattaattttcgggccaataatttaaaaaaatcgtgttatataatattatatgtattatatatatacatcatgatgatactgacagtcatgtcccattgctaaatagacagactccatctgccgcctccaactgatgttctcaatatttaaggggtcatctcgcattgtttaataataaacagactccatctaccgcctccaaatgatgttctcaaaatatattgtatgaacttatttttattacttagtattattagacaacttacttgctttatgaaaaacacttcctatttaggaaacaatttataatggcagttcgttcatttaacaatttatgtagaataaatgttataaatgcgtatgggaaatcttaaatatggatagcataaatgatatctgcattgcctaattcgaaatcaacagcaacgaaaaaaatcccttgtacaacataaatagtcatcgagaaatatcaactatcaaagaacagctattcacacgttactattgagattattattggacgagaatcacacactcaactgtctttctctcttctagaaatacaggtacaagtatgtactattctcattgttcatacttctagtcatttcatcccacatattccttggatttctctccaatgaatgacattctatcttgcaaattcaacaattataataagatataccaaagtagcggtatagtggcaatcaaaaagcttctctggtgtgcttctcgtatttatttttattctaatgatccattaaaggtatatatttatttcttgttatataatccttttgtttattacatgggctggatacataaaggtattttgatttaattttttgcttaaattcaatcccccctcgttcagtgtcaactgtaatggtaggaaattaccatacttttgaagaagcaaaaaaaatgaaagaaaaaaaaaatcgtatttccaggttagacgttccgcagaatctagaatgcggtatgcggtacattgttcttcgaacgtaaaagttgcgctccctgagatattgtacatttttgcttttacaagtacaagtacatcgtacaactatgtactactgttgatgcatccacaacagtttgttttgtttttttttgttttttttttttctaatgattcattaccgctatgtatacctacttgtacttgtagtaagccgggttattggcgttcaattaatcatagacttatgaatctgcacggtgtgcgctgcgagttacttttagcttatgcatgctacttgggtgtaatattgggatctgttcggaaatcaacggatgctcaatcgatttcgacagtaattaattaagtcatacacaagtcagctttcttcgagcctcatataagtataagtagttcaacgtattagcactgtacccagcatctccgtatcgagaaacacaacaacatgccccattggacagatcatgcggatacacaggttgtgcagtatcatacatactcgatcagacaggtcgtctgaccatcatacaagctgaacaagcgctccatacttgcacgctctctatatacacagttaaattacatatccatagtctaacctctaacagttaatcttctggtaagcctcccagccagccttctggtatcgcttggcctcctcaataggatctcggttctggccgtacagacctcggccgacaattatgatatccgttccggtagacatgacatcctcaacagttcggtactgctgtccgagagcgtctcccttgtcgtcaagacccaccccgggggtcagaataagccagtcctcagagtcgcccttaggtcggttctgggcaatgaagccaaccacaaactcggggtcggatcgggcaagctcaatggtctgcttggagtactcgccagtggccagagagcccttgcaagacagctcggccagcatgagcagacctctggccagcttctcgttgggagaggggactaggaactccttgtactgggagttctcgtagtcagagacgtcctccttcttctgttcagagacagtttcctcggcaccagctcgcaggccagcaatgattccggttccgggtacaccgtgggcgttggtgatatcggaccactcggcgattcggtgacaccggtactggtgcttgacagtgttgccaatatctgcgaactttctgtcctcgaacaggaagaaaccgtgcttaagagcaagttccttgagggggagcacagtgccggcgtaggtgaagtcgtcaatgatgtcgatatgggttttgatcatgcacacataaggtccgaccttatcggcaagctcaatgagctccttggtggtggtaacatccagagaagcacacaggttggttttcttggctgccacgagcttgagcactcgagcggcaaaggcggacttgtggacgttagctcgagcttcgtaggagggcattttggtggtgaagaggagactgaaataaatttagtctgcagaactttttatcggaaccttatctggggcagtgaagtatatgttatggtaatagttacgagttagttgaacttatagatagactggactatacggctatcggtccaaattagaaagaacgtcaatggctctctgggcgtcgcctttgccgacaaaaatgtgatcatgatgaaagccagcaatgacgttgcagctgatattgttgtcggccaaccgcgccgaaaacgcagctgtcagacccacagcctccaacgaagaatgtatcgtcaaagtgatccaagcacactcatagttggagtcgtactccaaaggcggcaatgacgagtcagacagatactcgtcgacgtttaaacagtgtacgcagatctactatagaggaacatttaaattgccccggagaagacggccaggccgcctagatgacaaattcaacaactcacagctgactttctgccattgccactaggggggggcctttttatatggccaagccaagctctccacgtcggttgggctgcacccaacaataaatgggtagggttgcaccaacaaagggatgggatggggggtagaagatacgaggataacggggctcaatggcacaaataagaacgaatactgccattaagactcgtgatccagcgactgacaccattgcatcatctaagggcctcaaaactacctcggaactgctgcgctgatctggacaccacagaggttccgagcactttaggttgcaccaaatgtcccaccaggtgcaggcagaaaacgctggaacagcgtgtacagtttgtcttaacaaaaagtgagggcgctgaggtcgagcagggtggtgtgacttgttatagcctttagagctgcgaaagcgcgtatggatttggctcatcaggccagattgagggtctgtggacacatgtcatgttagtgtacttcaatcgccccctggatatagccccgacaataggccgtggcctcatttttttgccttccgcacatttccattgctcgatacccacaccttgcttctcctgcacttgccaaccttaatactggtttacattgaccaacatcttacaagcggggggcttgtctagggtatatataaacagtggctctcccaatcggttgccagtctcttttttcctttctttccccacagattcgaaatctaaactacacatcacagaattccgagccgtgagtatccacgacaagatcagtgtcgagacgacgcgttttgtgtaatgacacaatccgaaagtcgctagcaacacacactctctacacaaactaacccagctctggtaccatggaggtcgtgaacgaaatcgtctccattggccaggaggttcttcccaaggtcgactatgctcagctctggtctgatgcctcgcactgcgaggtgctgtacgggtccatcgccttcgtcatcctgaagttcacccttggtcctctcggacccaagggtcagtctcgaatgaagtttgtgttcaccaactacaacctgctcatgtccatctactcgctgggctccttcctctctatggcctacgccatgtgtaccattggtgtcatgtccgacaactgcgagaaggctttcgacaacaatgtcttccgaatcaccactcagctgttctacctcagcaagttcctcgagtacattgactccttctatctgcccctcatgggcaagcctctgacctggttgcagttctttcaccatctcggagctcctatggacatgtggctgttctacaactaccgaaacgaagccgtttggatctttgtgctgctcaacggcttcattcactggatcatgtacggctactattggacccgactgcgaaagctcaagttccctatgcccaagtccctgattacttctatgcagatcattcagttcaacgttggcttctacatcgtctggaagtaccggaacattccctgctaccgacaagatggaatgagaatgtttggctggtttttcaactacttctacgttggtactgtcctgtgtctgttcctcaacttctacgtgaacacctacatcgtccgaaagcacaagggagccaaaaagattcagtgagc

SEQ ID NO: 377 - DNA, 777 bp, Euglena gracilis
  CDS (1)..(777): mutant delta-9 elongase "EgD9eS-A21V/L35G/W132T/I179R/Q244N"
atggaggtcgtgaacgaaatcgtctccattggccaggaggttcttcccaaggtcgactatgtgcagctctggtctgatgcctcgcactgcgaggtgctgtacgggtccatcgccttcgtcatcctgaagttcacccttggtcctctcggacccaagggtcagtctcgaatgaagtttgtgttcaccaactacaacctgctcatgtccatctactcgctgggctccttcctctctatggcctacgccatgtacaccattggtgtcatgtccgacaactgcgagaaggctttcgacaacaatgtcttccgaatcaccactcagctgttctacctcagcaagttcctcgagtacattgactccttctatctgcccctcatgggcaagcctctgaccaccttgcagttctttcaccatctcggagctcctatggacatgtggctgttctacaactaccgaaacgaagccgtttggatctttgtgctgctcaacggcttcattcactggatcatgtacggctactattggacccgactgcgaaagctcaagttccctatgcccaagtccctgattacttctatgcagatcattcagttcaacgttggcttctacatcgtctggaagtaccggaacattccctgctaccgacaagatggaatgagaatgtttggctggtttttcaactacttctacgttggtactgtcctgtgtctgttcctcaacttctacgtgaacacctacatcgtccgaaagcacaagggagccaaaaagattcagtga

SEQ ID NO: 378 - protein, 258 aa, Euglena gracilis
MEVVNEIVSIGQEVLPKVDYVQLWSDASHCEVLYGSIAFVILKFTLGPLGPKGQSRMKFVFTNYNLLMSIYSLGSFLSMAYAMYTIGVMSDNCEKAFDNNVFRITTQLFYLSKFLEYIDSFYLPLMGKPLTTLQFFHHLGAPMDMWLFYNYRNEAVWIFVLLNGFIHWIMYGYYWTRLRKLKFPMPKSLITSMQIIQFNVGFYIVWKYRNIPCYRQDGMRMFGWFFNYFYVGTVLCLFLNFYVNTYIVRKHKGAKKIQ

SEQ ID NO: 379 - DNA, 7769 bp, Artificial Sequence
  Plasmid EgD9eS-A21V/L35G/W132T/I179R/Q244N
ggccgcaagtgtggatggggaagtgagtgcccggttctgtgtgcacaattggcaatccaagatggatggattcaacacagggatatagcgagctacgtggtggtgcgaggatatagcaacggatatttatgtttgacacttgagaatgtacgatacaagcactgtccaagtacaatactaaacatactgtacatactcatactcgtacccgggcaacggtttcacttgagtgcagtggctagtgctcttactcgtacagtgtgcaatactgcgtatcatagtctttgatgtatatcgtattcattcatgttagttgcgtacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggtaccgggccccccctcgaggtcgatggtgtcgataagcttgatatcgaattcatgtcacacaaaccgatcttcgcctcaaggaaacctaattctacatccgagagactgccgagatccagtctacactgattaattttcgggccaataatttaaaaaaatcgtgttatataatattatatgtattatatatatacatcatgatgatactgacagtcatgtcccattgctaaatagacagactccatctgccgcctccaactgatgttctcaatatttaaggggtcatctcgcattgtttaataataaacagactccatctaccgcctccaaatgatgttctcaaaatatattgtatgaacttatttttattacttagtattattagacaacttacttgctttatgaaaaacacttcctatttaggaaacaatttataatggcagttcgttcatttaacaatttatgtagaataaatgttataaatgcgtatgggaaatcttaaatatggatagcataaatgatatctgcattgcctaattcgaaatcaacagcaacgaaaaaaatcccttgtacaacataaatagtcatcgagaaatatcaactatcaaagaacagctattcacacgttactattgagattattattggacgagaatcacacactcaactgtctttctctcttctagaaatacaggtacaagtatgtactattctcattgttcatacttctagtcatttcatcccacatattccttggatttctctccaatgaatgacattctatcttgcaaattcaacaattataataagatataccaaagtagcggtatagtggcaatcaaaaagcttctctggtgtgcttctcgtatttatttttattctaatgatccattaaaggtatatatttatttcttgttatataatccttttgtttattacatgggctggatacataaaggtattttgatttaattttttgcttaaattcaatcccccctcgttcagtgtcaactgtaatggtaggaaattaccatacttttgaagaagcaaaaaaaatgaaagaaaaaaaaaatcgtatttccaggttagacgttccgcagaatctagaatgcggtatgcggtacattgttcttcgaacgtaaaagttgcgctccctgagatattgtacatttttgcttttacaagtacaagtacatcgtacaactatgtactactgttgatgcatccacaacagtttgttttgtttttttttgttttttttttttctaatgattcattaccgctatgtatacctacttgtacttgtagtaagccgggttattggcgttcaattaatcatagacttatgaatctgcacggtgtgcgctgcgagttacttttagcttatgcatgctacttgggtgtaatattgggatctgttcggaaatcaacggatgctcaatcgatttcgacagtaattaattaagtcatacacaagtcagctttcttcgagcctcatataagtataagtagttcaacgtattagcactgtacccagcatctccgtatcgagaaacacaacaacatgccccattggacagatcatgcggatacacaggttgtgcagtatcatacatactcgatcagacaggtcgtctgaccatcatacaagctgaacaagcgctccatacttgcacgctctctatatacacagttaaattacatatccatagtctaacctctaacagttaatcttctggtaagcctcccagccagccttctggtatcgcttggcctcctcaataggatctcggttctggccgtacagacctcggccgacaattatgatatccgttccggtagacatgacatcctcaacagttcggtactgctgtccgagagcgtctcccttgtcgtcaagacccaccccgggggtcagaataagccagtcctcagagtcgcccttaggtcggttctgggcaatgaagccaaccacaaactcggggtcggatcgggcaagctcaatggtctgcttggagtactcgccagtggccagagagcccttgcaagacagctcggccagcatgagcagacctctggccagcttctcgttgggagaggggactaggaactccttgtactgggagttctcgtagtcagagacgtcctccttcttctgttcagagacagtttcctcggcaccagctcgcaggccagcaatgattccggttccgggtacaccgtgggcgttggtgatatcggaccactcggcgattcggtgacaccggtactggtgcttgacagtgttgccaatatctgcgaactttctgtcctcgaacaggaagaaaccgtgcttaagagcaagttccttgagggggagcacagtgccggcgtaggtgaagtcgtcaatgatgtcgatatgggttttgatcatgcacacataaggtccgaccttatcggcaagctcaatgagctccttggtggtggtaacatccagagaagcacacaggttggttttcttggctgccacgagcttgagcactcgagcggcaaaggcggacttgtggacgttagctcgagcttcgtaggagggcattttggtggtgaagaggagactgaaataaatttagtctgcagaactttttatcggaaccttatctggggcagtgaagtatatgttatggtaatagttacgagttagttgaacttatagatagactggactatacggctatcggtccaaattagaaagaacgtcaatggctctctgggcgtcgcctttgccgacaaaaatgtgatcatgatgaaagccagcaatgacgttgcagctgatattgttgtcggccaaccgcgccgaaaacgcagctgtcagacccacagcctccaacgaagaatgtatcgtcaaagtgatccaagcacactcatagttggagtcgtactccaaaggcggcaatgacgagtcagacagatactcgtcgacgtttaaacagtgtacgcagatctactatagaggaacatttaaattgccccggagaagacggccaggccgcctagatgacaaattcaacaactcacagctgactttctgccattgccactaggggggggcctttttatatggccaagccaagctctccacgtcggttgggctgcacccaacaataaatgggtagggttgcaccaacaaagggatgggatggggggtagaagatacgaggataacggggctcaatggcacaaataagaacgaatactgccattaagactcgtgatccagcgactgacaccattgcatcatctaagggcctcaaaactacctcggaactgctgcgctgatctggacaccacagaggttccgagcactttaggttgcaccaaatgtcccaccaggtgcaggcagaaaacgctggaacagcgtgtacagtttgtcttaacaaaaagtgagggcgctgaggtcgagcagggtggtgtgacttgttatagcctttagagctgcgaaagcgcgtatggatttggctcatcaggccagattgagggtctgtggacacatgtcatgttagtgtacttcaatcgccccctggatatagccccgacaataggccgtggcctcatttttttgccttccgcacatttccattgctcgatacccacaccttgcttctcctgcacttgccaaccttaatactggtttacattgaccaacatcttacaagcggggggcttgtctagggtatatataaacagtggctctcccaatcggttgccagtctcttttttcctttctttccccacagattcgaaatctaaactacacatcacagaattccgagccgtgagtatccacgacaagatcagtgtcgagacgacgcgttttgtgtaatgacacaatccgaaagtcgctagcaacacacactctctacacaaactaacccagctctggtaccatggaggtcgtgaacgaaatcgtctccattggccaggaggttcttcccaaggtcgactatgtgcagctctggtctgatgcctcgcactgcgaggtgctgtacgggtccatcgccttcgtcatcctgaagttcacccttggtcctctcggacccaagggtcagtctcgaatgaagtttgtgttcaccaactacaacctgctcatgtccatctactcgctgggctccttcctctctatggcctacgccatgtacaccattggtgtcatgtccgacaactgcgagaaggctttcgacaacaatgtcttccgaatcaccactcagctgttctacctcagcaagttcctcgagtacattgactccttctatctgcccctcatgggcaagcctctgaccaccttgcagttctttcaccatctcggagctcctatggacatgtggctgttctacaactaccgaaacgaagccgtttggatctttgtgctgctcaacggcttcattcactggatcatgtacggctactattggacccgactgcgaaagctcaagttccctatgcccaagtccctgattacttctatgcagatcattcagttcaacgttggcttctacatcgtctggaagtaccggaacattccctgctaccgacaagatggaatgagaatgtttggctggtttttcaactacttctacgttggtactgtcctgtgtctgttcctcaacttctacgtgaacacctacatcgtccgaaagcacaagggagccaaaaagattcagtgagc

SEQ ID NO: 380 - protein, 5 aa, Artificial Sequence
  HDGNH motif
HDGNH

SEQ ID NO: 381 - protein, 5 aa, Artificial Sequence
  HDANH motif
HDANH

SEQ ID NO: 382 - protein, 5 aa, Artificial Sequence
  HEFAH motif
HEFAH

SEQ ID NO: 383 - protein, 5 aa, Artificial Sequence
  HEFTH motif
HEFTH

SEQ ID NO: 384 - protein, 5 aa, Artificial Sequence
  HEMGH motif
HEMGH

SEQ ID NO: 385 - protein, 5 aa, Artificial Sequence
  HEAGH motif
HEAGH

SEQ ID NO: 386 - protein, 5 aa, Artificial sequence
  HDFGH motif
HDFGH

SEQ ID NO: 387 - protein, 5 aa, Artificial Sequence
  HDYGH motif
HDYGH

SEQ ID NO: 388 - protein, 5 aa, Artificial Sequence
  HDSCH motif
HDSCH

SEQ ID NO: 389 - protein, 5 aa, Artificial Sequence
  HDACH motif
HDACH

SEQ ID NO: 390 - protein, 5 aa, Artificial Sequence
  HDcSH motif
HDCSH

SEQ ID NO: 391 - protein, 5 aa, Artificial Sequence
  HDdSH motif
HDDSH

SEQ ID NO: 392 - protein, 5 aa, Artificial Sequence
  HDeSH motif
HDESH

SEQ ID NO: 393 - protein, 5 aa, Artificial Sequence
  HDfSH motif
HDFSH

SEQ ID NO: 394 - protein, 5 aa, Artificial Sequence
  HDhSH motif
HDHSH

SEQ ID NO: 395 - protein, 5 aa, Artificial Sequence
  HDiSH motif
HDISH

SEQ ID NO: 396 - protein, 5 aa, Artificial Sequence
  HDkSH motif
HDKSH

SEQ ID NO: 397 - protein, 5 aa, Artificial Sequence
  HDlSH motif
HDLSH

SEQ ID NO: 398 - protein, 5 aa, Artificial Sequence
  HDmSH motif
HDMSH

SEQ ID NO: 399 - protein, 5 aa, Artificial Sequence
  HDnSH motif
HDNSH

SEQ ID NO: 400 - protein, 5 aa, Artificial Sequence
  HDpSH motif
HDPSH

SEQ ID NO: 401 - protein, 5 aa, Artificial Sequence
  HDqSH motif
HDQSH

SEQ ID NO: 402 - protein, 5 aa, Artificial Sequence
  HDrSH motif
HDRSH

SEQ ID NO: 403 - protein, 5 aa, Artificial Sequence
  HDtSH motif
HDTSH

SEQ ID NO: 404 - protein, 5 aa, Artificial Sequence
  HDvSH motif
HDVSH

SEQ ID NO: 405 - protein, 5 aa, Artificial Sequence
  HDwSH motif
HDWSH

SEQ ID NO: 406 - protein, 5 aa, Artificial Sequence
  HDySH motif
HDYSH

SEQ ID NO: 407 - protein, 5 aa, Artificial Sequence
  HDAcH motif
HDACH

SEQ ID NO: 408 - protein, 6 aa, Artificial Sequence
  HDAdH motif
VHDADH

SEQ ID NO: 409 - protein, 5 aa, Artificial Sequence
  HDAeH motif
HDAEH

SEQ ID NO: 410 - protein, 5 aa, Artificial Sequence
  HDAfH motif
HDAFH

SEQ ID NO: 411 - protein, 5 aa, Artificial Sequence
  HDAhH motif
HDAHH

SEQ ID NO: 412 - protein, 5 aa, Artificial Sequence
  HDAiH motif
HDAIH

SEQ ID NO: 413 - protein, 5 aa, Artificial Sequence
  HDAkH motif
HDAKH

SEQ ID NO: 414 - protein, 5 aa, Artificial Sequence
  HDAlH motif
HDALH

SEQ ID NO: 415 - protein, 5 aa, Artificial Sequence
  HDAmH motif
HDAMH

SEQ ID NO: 416 - protein, 5 aa, Artificial Sequence
  HDAnH motif
HDANH

SEQ ID NO: 417 - protein, 5 aa, Artificial Sequence
  HDApH motif
HDAPH

SEQ ID NO: 418 - protein, 5 aa, Artificial Sequence
  HDAqH motif
HDAQH

SEQ ID NO: 419 - protein, 5 aa, Artificial Sequence
  HDArH motif
HDARH

SEQ ID NO: 420 - protein, 5 aa, Artificial Sequence
  HDAtH motif
HDATH

SEQ ID NO: 421 - protein, 5 aa, Artificial Sequence
  HDAvH motif
HDAVH

SEQ ID NO: 422 - protein, 5 aa, Artificial Sequence
  HDAwH motif
HDAWH

SEQ ID NO: 423 - protein, 5 aa, Artificial Sequence
  HDAyH motif
HDAYH

SEQ ID NO: 424 - protein, 5 aa, Artificial Sequence
  HDxxH motif
  misc_feature (3)..(4): Xaa can be any naturally occurring amino acid
HDXXH

SEQ ID NO: 425 - protein, 4 aa, Artificial Sequence
  HGGG motif
HGGG

SEQ ID NO: 426 - protein, 4 aa, Artificial Sequence
  HHGG motif
HHGG

SEQ ID NO: 427 - protein, 4 aa, Artificial Sequence
  HPGS motif
HPGS

SEQ ID NO: 428 - protein, 4 aa, Artificial Sequence
  HAGG motif
HAGG

SEQ ID NO: 429 - protein, 5 aa, Artificial Sequence
  HDGSH motif
HDGSH

SEQ ID NO: 430 - protein, 5 aa, Artificial Sequence
  HDSSH motif
HDSSH

SEQ ID NO: 431 - protein, 5 aa, Artificial Sequence
  HDAAH motif
HDAAH

SEQ ID NO: 432 - protein, 5 aa, Artificial Sequence
  HDAGH motif
HDAGH

SEQ ID NO: 433 - protein, 5 aa, Artificial Sequence
  HEASH motif
HEASH

SEQ ID NO: 434 - protein, 5 aa, Artificial Sequence
  HDXSH motif
  misc_feature (3)..(3): Xaa can be any naturally occurring amino acid
HDXSH

SEQ ID NO: 435 - protein, 5 aa, Artificial Sequence
  HDAXH motif
  misc_feature (4)..(4): Xaa can be any naturally occurring amino acid
HDAXH

What is claimed is:

1. A recombinant microbial host cell producing an oil comprising eicosapentaenoic acid, wherein the eicosapentaenoic acid is at least 25 weight percent of the dry cell weight of said microbial host cell, wherein said microbial host cell is an oleaginous yeast.

2. The recombinant microbial host cell of claim 1, wherein the oil comprises at least 45 weight percent of eicosapentaenoic acid measured as a weight percent of the total fatty acids of the oil.

3. The recombinant microbial host cell of either of claim 1 or 2, wherein the oil has a ratio of at least 2.4:1 of eicosapentaenoic acid, measured as a weight percent of the total fatty acids of the oil, to linoleic acid, measured as a weight percent of the total fatty acids of the oil.

4. The recombinant microbial host cell of claim 1, wherein the oleaginous yeast is *Yarrowia*.

5. The recombinant microbial host cell of claim 2, wherein the oil comprises at least 50 weight percent of eicosapentaenoic acid measured as a weight percent of the total fatty acids of the oil.

6. The recombinant microbial host cell of claim 5, wherein the oil comprises at least 55 weight percent of eicosapentaenoic acid measured as a weight percent of the total fatty acids of the oil.

7. The recombinant microbial host cell of claim 1, wherein the eicosapentaenoic acid is at least 28 weight percent of the dry cell weight of said microbial host cell.

* * * * *